(12) United States Patent
Keating et al.

(10) Patent No.: US 12,331,297 B2
(45) Date of Patent: Jun. 17, 2025

(54) COAGULATION FACTOR V (F5) iRNA COMPOSITIONS AND METHODS OF USE THEREOF

(71) Applicant: Alnylam Pharmaceuticals, Inc., Cambridge, MA (US)

(72) Inventors: Mark Keating, Weston, MA (US); James D. McIninch, Burlington, MA (US); Mark K. Schlegel, Boston, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 18/586,689

(22) Filed: Feb. 26, 2024

(65) Prior Publication Data
US 2024/0218366 A1 Jul. 4, 2024

Related U.S. Application Data

(60) Division of application No. 18/144,276, filed on May 8, 2023, which is a continuation of application No. PCT/US2021/059047, filed on Nov. 12, 2021.

(60) Provisional application No. 63/271,872, filed on Oct. 26, 2021, provisional application No. 63/146,115, filed on Feb. 5, 2021, provisional application No. 63/113,282, filed on Nov. 13, 2020.

(51) Int. Cl.
*C12N 15/113* (2010.01)
*A61K 9/00* (2006.01)
*A61K 45/06* (2006.01)
*A61K 47/54* (2017.01)
*A61P 7/02* (2006.01)

(52) U.S. Cl.
CPC .......... *C12N 15/113* (2013.01); *A61K 9/0019* (2013.01); *A61K 45/06* (2013.01); *A61K 47/549* (2017.08); *A61P 7/02* (2018.01); *C12N 2310/11* (2013.01); *C12N 2310/3125* (2013.01); *C12N 2310/313* (2013.01)

(58) Field of Classification Search
CPC .............. C12N 15/113; C12N 2310/11; C12N 2310/3125; C12N 2310/313; C12N 2310/14; C12N 2310/315; C12N 2310/343; C12N 2310/346; C12N 2310/321; C12N 2310/322
See application file for complete search history.

(56) References Cited

U.S. PATENT DOCUMENTS

| | | | |
|---|---|---|---|
| 6,083,905 A | 7/2000 | Voorberg et al. | |
| 6,830,884 B1 | 12/2004 | Hafner et al. | |
| 7,427,605 B2 | 9/2008 | Davis et al. | |
| 7,718,629 B2 | 5/2010 | Bumcrot et al. | |
| 8,658,782 B2 | 2/2014 | Vornlocher et al. | |
| 9,441,225 B2 | 9/2016 | Vornlocher et al. | |
| 10,501,740 B2 | 12/2019 | Vornlocher et al. | |
| 2003/0143732 A1 | 7/2003 | Fosnaugh et al. | |
| 2003/0170891 A1 | 9/2003 | McSwiggen | |
| 2004/0192626 A1 | 9/2004 | McSwiggen et al. | |
| 2004/0259247 A1 | 12/2004 | Tuschl et al. | |
| 2005/0107325 A1 | 5/2005 | Manoharan et al. | |
| 2005/0176667 A1 | 8/2005 | Vornlocher | |
| 2006/0068405 A1 | 3/2006 | Diber et al. | |
| 2006/0263435 A1 | 11/2006 | Davis et al. | |
| 2007/0004664 A1 | 1/2007 | McSwiggen et al. | |
| 2007/0031844 A1 | 2/2007 | Khvorova et al. | |
| 2007/0054275 A1 | 3/2007 | Dogulu et al. | |
| 2007/0065844 A1 | 3/2007 | Golub et al. | |
| 2007/0281899 A1 | 12/2007 | Bumcrot et al. | |
| 2009/0149403 A1 | 6/2009 | MacLachlan et al. | |
| 2010/0069461 A1 | 3/2010 | Vornlocher et al. | |
| 2011/0015250 A1 | 1/2011 | Bumcrot et al. | |
| 2012/0244207 A1 | 9/2012 | Fitzgerald et al. | |
| 2017/0121709 A1 | 5/2017 | Vornlocher et al. | |
| 2020/0231968 A1 | 7/2020 | Vornlocher et al. | |
| 2021/0189393 A1 | 6/2021 | Vornlocher et al. | |

FOREIGN PATENT DOCUMENTS

| | | | | |
|---|---|---|---|---|
| EP | 1752536 A1 | 2/2007 | | |
| WO | WO-0123612 A2 | 4/2001 | | |
| WO | WO-2004/080406 A2 | 9/2004 | | |
| WO | WO-2004/090108 A2 | 10/2004 | | |
| WO | WO-2005/007843 A2 | 1/2005 | | |
| WO | WO-2007/056331 A2 | 5/2007 | | |
| WO | WO-2008/043561 A2 | 4/2008 | | |
| WO | WO-2010/147992 A1 | 12/2010 | | |
| WO | WO-2013075035 A1 * | 5/2013 | ......... | A61K 31/7088 |
| WO | WO-2022/103999 A1 | 5/2022 | | |

OTHER PUBLICATIONS

NCBI Reference Sequence NM_000130 *Homo sapiens* coagulation factor V (F5) mRNA sequence (Year: 2019).*
Hu, B., Zhong, L., Weng, Y. et al. Therapeutic siRNA: state of the art. Sig Transduct Target Ther 5, 101 (2020). https://doi.org/10.1038/s41392-020-0207-x (Year: 2020).*
Nair et al. Impact of enhanced metabolic stability on pharmacokinetics and pharmacodynamics of GalNAc-siRNA conjugates. Nucleic Acids Res. Nov. 2, 2017;45(19):10969-10977. doi: 10.1093/nar/gkx818. PMID: 28981809; PMCID: PMC5737438. (Year: 2017).*
Kumiko Ui-Tei et al. Functional dissection of siRNA sequence by systematic DNA substitution: modified siRNA with a DNA seed arm is a powerful tool for mammalian gene silencing with significantly reduced off-target effect, Nucleic Acids Research, vol. 36, Issue 7, Apr. 1, 2008, pp. 2136-2151. (Year: 2008).*

(Continued)

*Primary Examiner* — Richard A Schnizer
*Assistant Examiner* — Amanda M Zahorik
(74) *Attorney, Agent, or Firm* — McCarter & English, LLP; Maria Laccotripe Zacharakis; Deborah L. Nagle

(57) ABSTRACT

The present invention relates to RNAi agents, e.g., dsRNA agents, targeting the Coagulation Factor V (F5) gene. The invention also relates to methods of using such RNAi agents to inhibit expression of an F5 gene and to methods of treating or preventing an F5-associated disease, e.g., a disorder associated with thrombosis, in a subject.

28 Claims, 3 Drawing Sheets
Specification includes a Sequence Listing.

(56) References Cited

OTHER PUBLICATIONS

Foster, Donald J. et al. Advanced siRNA Designs Further Improve In Vivo Performance of GalNAc-siRNA Conjugates. Molecular Therapy, vol. 26, Issue 3, 708-717 (Year: 2018).*
Shukla, S., Sumaria, C. and Pradeepkumar, P. (2010), Exploring Chemical Modifications for siRNA Therapeutics: A Structural and Functional Outlook. Chem MedChem, 5: 328-349. https://doi.org/10.1002/cmdc.200900444 (Year: 2010).*
U.S. Appl. No. 18/144,276, filed May 8, 2023, Pending.
PCT/US2021/059047, Nov. 12, 2021, WO 2022/103999, Completed.
U.S. Appl. No. 12/093,235, filed Nov. 5, 2008, US 20100069461, Abandoned.
U.S. Appl. No. 13/010,300 U.S. Pat. No. 8,658,782, filed Jan. 20, 2011 Feb. 25, 2014, US 20110130443, Granted.
U.S. Appl. No. 14/155,239 U.S. Pat. No. 9,441,225, filed Jan. 14, 2014 Sep. 13, 2016, US 20140206747, Granted.
U.S. Appl. No. 15/241,025, filed Aug. 18, 2016, US 20170121709, Abandoned.
U.S. Appl. No. 15/676,874 U.S. Pat. No. 10,501,740, filed Aug. 14, 2017, US 20180127749, Granted.
U.S. Appl. No. 16/673,865, filed Nov. 4, 2019, US 20200231968, Abandoned.
U.S. Appl. No. 17/183,205, filed Feb. 23, 2021, US 20210189393, Abandoned.
PCT/US2006/043271, Nov. 7, 2006, WO 2007/056331, Completed.
International Search Report and Written Opinion from PCT/US2021/059047, mailed Feb. 24, 2022.
Agrawal, S., et al., "Antisense oligonucleotides: towards clinical trials." Trends in Biotechnology. Oct. 1996, vol. 14, pp. 376-387.
Amarzguioui, M., et al., "Tolerance for mutations and chemical modifications in a siRNA," Nucleic Acids Research, 2003, pp. 589-595, vol. 31, No. 2.
Bass, B., "The short answer," Nature, May 24, 2001, pp. 428-429, vol. 411.
Braun, et al., "Population study of the G1691 A mutation (R506Q, FV Leiden) in the human factor V gene that is associated with resistance to activated protein C," 1996, Human Genetics, vol. 97, pp. 263-264.
Elbashir, S., et al., "Analysis of gene function in somatic mammalian cells using small interfering RNAs, "Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in *Drosophila melanogaster* Embryo Lysate", The EMBO Journal, 2001, pp. 6877-6888, vol. 20, No. 23.
Elbashir, S., et al., "RNA Interference is Mediated by 21-and 22 Nucleotide RNAs," Genes & Development, 2001, pp. 188-200, vol. 15.
Fire, A., "RNA-triggered Gene Silencing," Trends in Genetics, Sep. 1999, pp. 358-363, vol. 15, No. 9.
Fire, A., et al., "Potent and Specific Genetic Interference by Double Stranded RNA in Caenorhabditis elegans," Nature, Feb. 19, 1998, pp. 806-811, vol. 391.
Hornung, V., et al., "Sequence-specific potent induction of IFN-a by short interfering RNA in plasmacytoid dendritic cells throughTLR7," Nature Medicine, Mar. 2005, pp. 263-270, vol. 11, No. 3.
Naito, et al., "siDirect: highly effective, target-specific siRNA design software for mammalian RNA interference," 2004, Nucleic Acids Research, vol. 32, pp. W124-W129.
International Search Report and Written Opinion, PCT/US2006/043271, Mar. 5, 2008.
Price, et al., "Factor V Leiden mutation and the risks for thromboembolic disease: A clinical perspective," 1997, Annals of Internal Medicine, vol. 127, pp. 895-903.
Reynolds, et al. (2004) "Rational siRNA design for RNA interference," Nature Biotechnology, vol. 22, No. 3, pp. 326-330.
Robbins, M., et al., "Stable expression of shRNAs in human CD34+ progenitor cells can avoid induction of interferon responses to siRNAs in vitro," Nature Biotechnology, May 2006, pp. 566-571, vol. 24, No. 5.
Rose, S., et al., "Functional polarity is introduced by Dicer processing of short substrate RNAs," Nucleic Acids Research, 2005, pp. 4140-4156, vol. 33, No. 13.
Tuschl T., "RNA Interference and Small Interfering RNAs" Chembiochem, 2001, pp. 239-245, vol. 2.
Tuschl, T., "Expanding small RNA interference," Nature Biotechnology, May 2002, pp. 446-448, vol. 20.
Tuschl, T., "Functional genomics: RNA sets the standard," Nature, Jan. 16, 2003, vol. 421, No. 6920, pp. 220-221.
Tuschl, T., "Mammalian RNA Interference," RNAi, A Guide to Gene Silencing, Chapter 13, G.J. Hannon (ed,), 2003, pp. 265-295.
Tuschl, T., et al., "Small Interfering RNAs: A Revolutionary Tool for the Analysis of Gene Function and Gene Therapy," Molecular Interventions, 2002, pp. 158-167, vol. 2, No. 3.
Tuschl, T., et al., "Targeted mRNA Degradation by Double-Stranded RNA In Vitro," Genes & Development, 1999, pp. 3191-3197, vol. 13.
Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.
Weil, et al.(2002) "Targeting the Kinesin Eg5 to Monitor siRNA Transfection in Mammalian Cells," Biotechniques 33(6): 1244-1248.
Zimmerman, et al. (2006) "RNAi-mediated gene silencing in non-human primates," Nature, vol. 441, May 4:111-114.

* cited by examiner

COAGULATION FACTOR V (F5) iRNA COMPOSITIONS AND METHODS OF USE THEREOF

RELATED APPLICATIONS

This application is a divisional of U.S. patent application Ser. No. 18/144,276, filed on May 8, 2023, which is a 35 § U.S.C. 111(a) continuation application which claims the benefit of priority to PCT/US2021/059047, filed on Nov. 12, 2021, which, in turn, claims the benefit of priority to U.S. Provisional Application No. 63/113,282, filed on Nov. 13, 2020, U.S. Provisional Application No. 63/146,115, filed on Feb. 5, 2021, and U.S. Provisional Application No. 63/271,872, filed on Oct. 26, 2021. The entire contents of each of the foregoing applications are incorporated herein by reference.

SEQUENCE LISTING

The instant application contains a Sequence Listing which has been filed electronically in XML file format and is hereby incorporated by reference in its entirety. Said XML copy, created on Feb. 21, 2024, is named 121301_13505_SL.xml and is 20,876,779 bytes in size.

BACKGROUND OF THE INVENTION

Coagulation Factor V (F5) is a plasma glycoprotein synthesized as a single-chain inactive precursor in the liver. Activation of F5 occurs via ordered proteolysis at three sites on the protein by thrombin. The proteolytically activated form of F5 (F5a) binds tightly to thrombin in the presence of ionic calcium and an anionic phospholipid surface to produce a potent procoagulant, i.e., an activated thrombin. Activated thrombin, in turn, cleaves fibrinogen to form fibrin, which polymerizes to form the dense meshwork that makes up the majority of a clot. Activated protein C is a natural anticoagulant that acts to limit the extent of clotting by cleaving and degrading F5. F5 is also secreted from activated platelets, thus helping to localize thrombin activity to the site of vascular damage (see, e.g., FIG. 1).

As with thrombin, unregulated activation or activity of F5 may lead to generation of excess fibrin and excess clotting, thereby leading to the development of disorders associated with thrombosis.

Formation of excess clotting within a blood vessel results in thrombosis which prevents blood from flowing normally through the circulatory system. When a blood clot forms in the veins, it is known as venous thromboembolism such as deep vein thrombosis. If the venous clots break off, these clots can travel through the heart to the lung, where they block a pulmonary blood vessel and cause a pulmonary embolism. When a clot forms in the arteries, it is called atherothrombosis, which can lead to heart attack and stroke.

The common treatment for thrombosis is typically non-selective anti-coagulant therapy. Unfortunately, however, the lack of specificity of such therapies can lead to excessive bleeding.

Accordingly, there is a need in the art for more effective treatments for subjects suffering from or prone to suffering from thrombosis.

SUMMARY OF THE INVENTION

The present invention provides iRNA compositions which effect the RNA-induced silencing complex (RISC)-mediated cleavage of RNA transcripts of a gene encoding coagulation Factor V (F5). The F5 may be within a cell, e.g., a cell within a subject, such as a human subject.

Accordingly, in one aspect the invention provides a double stranded ribonucleic acid (dsRNA) agent for inhibiting expression of F5 in a cell, wherein the dsRNA agent comprises a sense strand and an antisense strand forming a double stranded region, wherein the sense strand comprises at least 15 contiguous nucleotides differing by no more than 0, 1, 2, or 3 nucleotides from the nucleotide sequence of SEQ ID NO:1 and the antisense strand comprises at least 15 contiguous nucleotides differing by no more than 1, 2, or 3 nucleotides from the nucleotide sequence of SEQ ID NO:2. In certain embodiments, the sense strand comprises at least 15 contiguous nucleotides of the nucleotide sequence of SEQ ID NO: 1 and the antisense strand comprises at least 15 contiguous nucleotides of the nucleotide sequence of SEQ ID NO:4. In certain embodiments, the sense strand comprises at least 17 contiguous nucleotides of the nucleotide sequence of SEQ ID NO: 1 and the antisense strand comprises at least 17 contiguous nucleotides of the nucleotide sequence of SEQ ID NO:5. In certain embodiments, the sense strand comprises at least 19 contiguous nucleotides of the nucleotide sequence of SEQ ID NO: 1 and the antisense strand comprises at least 19 contiguous nucleotides of the nucleotide sequence of SEQ ID NO:5.

In another aspect, the present invention provides a double stranded ribonucleic acid (dsRNA) for inhibiting expression of coagulation Factor V (F5) in a cell, wherein the dsRNA agent comprises a sense strand and an antisense strand forming a double stranded region, wherein the antisense strand comprises a region of complementarity to an mRNA encoding F5, and wherein the region of complementarity comprises at least 15 contiguous nucleotides differing by no more than 0, 1, 2, or 3 nucleotides from any one of the antisense nucleotide sequences in any one of Tables 2, 3, 5, 6-8, 10 and 11. In certain embodiments, the region of complementarity comprises at least 15 contiguous nucleotides of any one of the antisense nucleotide sequences in any one of Tables 2, 3, 5, 6-8, 10 and 11. In certain embodiments, the region of complementarity comprises at least 17 contiguous nucleotides of any one of the antisense nucleotide sequences in any one of Tables 2, 3, 5, 6-8, 10 and 11. In certain embodiments, the region of complementarity comprises at least 19 contiguous nucleotides of any one of the antisense nucleotide sequences in any one of Tables 2, 3, 5, 6-8, 10 and 11. In certain embodiments, the region of complementarity comprises at least 20 contiguous nucleotides of any one of the antisense nucleotide sequences in any one of Tables 2, 3, 5, 6-8, 10 and 11. In certain embodiments, the region of complementarity comprises at least 21 contiguous nucleotides of any one of the antisense nucleotide sequences in any one of Tables 2, 3, 5, 6-8, 10 and 11.

In one aspect, the present invention provides a double stranded ribonucleic acid (dsRNA) for inhibiting expression of coagulation Factor V (F5) in a cell, wherein said dsRNA comprises a sense strand and an antisense strand forming a double stranded region, wherein the sense strand comprises at least 15 contiguous nucleotides differing by no more than three nucleotides from any one of the nucleotide sequence of nucleotides 640-668; 747-771; 755-784; 830-855; 1226-1262; 3351-3380; 5821-5858; 5874-5910; 6104-6149; and 6245-6277 of SEQ ID NO: 1, and the antisense strand comprises at least 15 contiguous nucleotides from the corresponding nucleotide sequence of SEQ ID NO:5.

In one aspect, the present invention provides a double stranded ribonucleic acid (dsRNA) agent for inhibiting expression of coagulation Factor V (F5) in a cell, wherein the dsRNA agent comprises a sense strand and an antisense strand forming a double stranded region, wherein the sense strand comprises at least 15 contiguous nucleotides differing by no more than three nucleotides from any one of the nucleotide sequence of nucleotides 643-665; 645-667; 346-368; 5830-5852; 6104-6126; 6909-6931; and 1104-1126 of SEQ ID NO: 1, and the antisense strand comprises at least 15 contiguous nucleotides from the corresponding nucleotide sequence of SEQ ID NO:5.

In one aspect, the present invention provides a double stranded ribonucleic acid (dsRNA) agent for inhibiting expression of coagulation Factor V (F5) in a cell, wherein the dsRNA agent comprises a sense strand and an antisense strand forming a double stranded region, wherein the sense strand comprises at least 15 contiguous nucleotides differing by no more than three nucleotides from any one of the nucleotide sequence of nucleotides 5830-5852; and 6909-6931 of SEQ ID NO: 1, and the antisense strand comprises at least 15 contiguous nucleotides from the corresponding nucleotide sequence of SEQ ID NO:5.

In one embodiment, the antisense strand and the sense strand comprises at least 15 contiguous nucleotides differing by no more than 0, 1, 2, 3 or 4 nucleotides from any one of the antisense strand nucleotide sequences and the sense strand nucleotide sequences, respectively, of a duplex selected from the group consisting of AD-109630; AD-1465920; AD-1465922; AD-1615171; AD-1615234; AD-1615253; AD-1615278; and AD-1615312.

In one embodiment, the antisense strand comprises at least 15 contiguous nucleotides differing by no more than 0, 1, 2, or 3 nucleotides from any one of the antisense strand nucleotide sequences of a duplex selected from the group consisting of AD-1615234; and AD-1615278.

In some embodiments, the dsRNA agent is selected from the group consisting of AD-109630; AD-1465920; AD-1465922; AD-1615171; AD-1615234; AD-1615253; AD-1615278; and AD-1615312, wherein AD-109630 comprises a sense strand comprising the nucleotide sequence 5'-CAGGCUUACAUUGA-CAUUAAA-3' (SEQ ID NO: 9) and an antisense strand comprising the nucleotide sequence 5'-UUUAAUGU-CAAUGUAAGCCUGCA-3' (SEQ ID NO: 10);

wherein AD-1465920 comprises a sense strand comprising the nucleotide sequence 5'-GCCUCACACA-CAUCUAUUACU-3' (SEQ ID NO: 11) and an antisense strand comprising the nucleotide sequence 5'-AGUAAUAGAUGTGUGUGAGGCAU-3' (SEQ ID NO: 12);

wherein AD-1465922 comprises a sense strand comprising the nucleotide sequence 5'-CUCACACACAUC-UAUUACUCU-3' (SEQ ID NO: 13) and an antisense strand comprising the nucleotide sequence 5'-AGAGTAAUAGATGUGUGUGAGGC-3' (SEQ ID NO: 14);

wherein AD-1615171 comprises a sense strand comprising the nucleotide sequence 5'-AGUAUGAAC-CAUAUUUAAGU-3' (SEQ ID NO: 15) and an antisense strand comprising the nucleotide sequence 5'-ACUUAAAAUAUGGUUCAUACUCU-3' (SEQ ID NO: 16);

wherein AD-1615234 comprises a sense strand comprising the nucleotide sequence 5'-UGCAAACGC-CAUUUCUUAUCU-3' (SEQ ID NO: 17) and an antisense strand comprising the nucleotide sequence 5'-AGAUAAGAAAUGGCGUUUGCAUC-3' (SEQ ID NO: 18);

wherein AD-1615253 comprises a sense strand comprising the nucleotide sequence 5'-CUGCUAUAC-CACACAGAGUUCUU-3' (SEQ ID NO: 19) and an antisense strand comprising the nucleotide sequence 5'-AAGAACTCUGUGGUAUAGCAGGA-3' (SEQ ID NO: 20);

wherein AD-1615278 comprises a sense strand comprising the nucleotide sequence 5'-ACAGUUUUCCAC-UAUUUCUCU-3' (SEQ ID NO: 21) and an antisense strand comprising the nucleotide sequence 5'-AGAGAAAUAGUGGAAAACUGUUA-3' (SEQ ID NO: 22); and wherein AD-1615278 comprises a sense strand comprising the nucleotide sequence 5'-ACAGUUUUCCAC-UAUUUCUCU-3' (SEQ ID NO: 21) and an antisense strand comprising the nucleotide sequence 5'-AGAGAAAUAGUGGAAAACUGUUA-3' (SEQ ID NO: 22); and wherein AD-1615312 comprise a sense strand comprising the nucleotide sequence 5'-CAGGCUUA-CAUUGAUAUUAAU-3' (SEQ ID NO: 23) and an antisense strand comprising the nucleotide sequence 5'-AUUAAUAUCAAUGUAAGCCUGCG-3' (SEQ ID NO: 24).

In some embodiments, the dsRNA agent is selected from the group consisting of AD-1615234; and AD-1615278, wherein AD-1615234 comprises a sense strand comprising the nucleotide sequence 5'-UGCAAACGC-CAUUUCUUAUCU-3' (SEQ ID NO: 17) and an antisense strand comprising the nucleotide sequence 5'-AGAUAAGAAAUGGCGUUUGCAUC-3' (SEQ ID NO: 18);

and wherein AD-1615278 comprises a sense strand comprising the nucleotide sequence 5'-ACAGUUUUCCA-CUAUUUCUCU-3' (SEQ ID NO: 21) and an antisense strand comprising the nucleotide sequence 5'-AGAGAAAUAGUGGAAAACUGUUA-3' (SEQ ID NO: 22).

In one embodiment, the dsRNA agent comprises at least one modified nucleotide.

In one embodiment, substantially all of the nucleotides of the sense strand comprise a modification; substantially all of the nucleotides of the antisense strand comprise a modification; or substantially all of the nucleotides of the sense strand and substantially all of the nucleotides of the antisense strand comprise a modification.

In one embodiment, all of the nucleotides of the sense strand comprise a modification; all of the nucleotides of the antisense strand comprise a modification; or all of the nucleotides of the sense strand and all of the nucleotides of the antisense strand comprise a modification.

In one embodiment, at least one of the modified nucleotides is selected from the group consisting of a deoxynucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a thermally destabilizing nucleotide, a glycol modified nucleotide (GNA), and a 2-O—(N-methylacetamide) modified nucleotide; and combinations thereof.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and glycol; and combinations thereof.

In one embodiment, at least one of the modified nucleotides is selected from the group consisting of a deoxynucleotide, a 2'-O-methyl modified nucleotide, a 2'-fluoro modified nucleotide, a 2'-deoxy-modified nucleotide, a glycol modified nucleotide (GNA), e.g., Ggn, Cgn, Tgn, or Agn, and, a vinyl-phosphonate nucleotide; and combinations thereof.

In another embodiment, at least one of the modifications on the nucleotides is a thermally destabilizing nucleotide modification.

In one embodiment, the thermally destabilizing nucleotide modification is selected from the group consisting of an abasic modification; a mismatch with the opposing nucleotide in the duplex; a destabilizing sugar modification, a 2'-deoxy modification, an acyclic nucleotide, an unlocked nucleic acid (UNA), and a glycerol nucleic acid (GNA).

The double stranded region may be 19-30 nucleotide pairs in length; 19-25 nucleotide pairs in length; 19-23 nucleotide pairs in length; 23-27 nucleotide pairs in length; or 21-23 nucleotide pairs in length.

In one embodiment, each strand is independently no more than 30 nucleotides in length.

In one embodiment, the sense strand is 21 nucleotides in length and the antisense strand is 23 nucleotides in length.

The region of complementarity may be at least 17 nucleotides in length; 19-23 nucleotides in length; or 19 nucleotides in length.

In one embodiment, at least one strand comprises a 3' overhang of at least 1 nucleotide. In another embodiment, at least one strand comprises a 3' overhang of at least 2 nucleotides.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

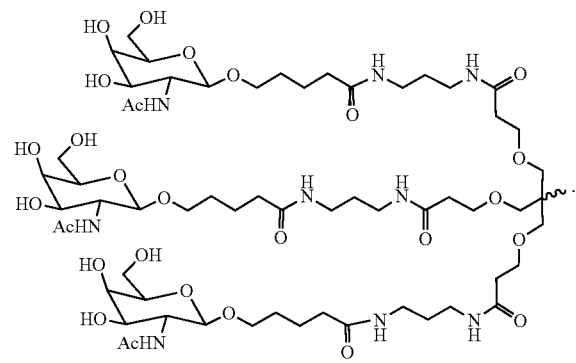

In one embodiment, the dsRNA agent is conjugated to the ligand as shown in the following schematic

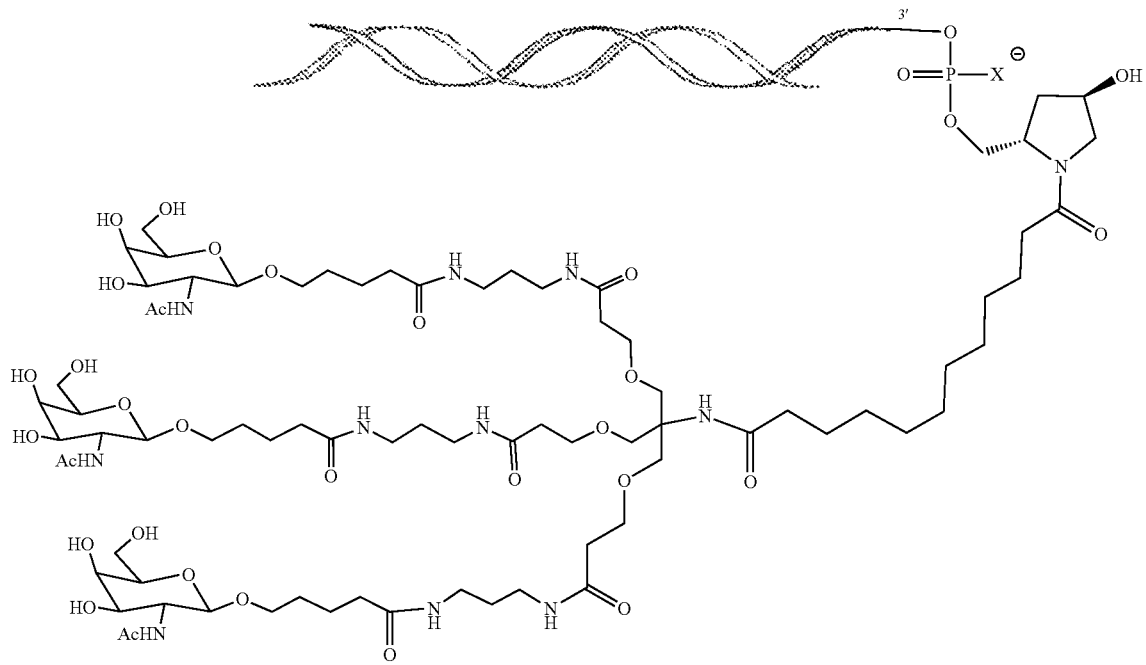

and, wherein X is O or S.

In one embodiment, the X is O.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand, e.g., the antisense strand or the sense strand.

In another embodiment, the phosphorothioate or methylphosphonate internucleotide linkage is at the 5'-terminus of one strand, e.g., the antisense strand or the sense strand.

In one embodiment, the phosphorothioate or methylphosphonate internucleotide linkage is at both the 5'- and 3'-terminus of one strand, e.g., the antisense strand or the sense strand. In one embodiment, the strand is the antisense strand.

In one embodiment, the base pair at the 1 position of the 5'-end of the antisense strand of the duplex is an AU base pair.

The present invention also provides cells containing any of the dsRNA agents of the invention and pharmaceutical compositions comprising any of the dsRNA agents of the invention.

The pharmaceutical composition of the invention may include the dsRNA agent in an unbuffered solution, e.g., saline or water, or the pharmaceutical composition of the invention may include the dsRNA agent in a buffer solution, e.g., a buffer solution comprising acetate, citrate, prolamine, carbonate, or phosphate or any combination thereof; or phosphate buffered saline (PBS).

In one aspect, the present invention provides a method of inhibiting expression of a coagulation Factor V (F5) gene in a cell. The method includes contacting the cell with any of the dsRNA agents of the invention or any of the pharmaceutical compositions of the invention, thereby inhibiting expression of the F5 gene in the cell.

In one embodiment, the cell is within a subject, e.g., a human subject, e.g., a subject having a coagulation Factor V-(F5)-associated disease. Such diseases are typically associated with excess formation of blood clots, e.g., thrombosis. In certain embodiments, the F5-associated disease or disorder is a disease or disorder associated with thrombosis. Non-limiting examples of disorders or diseases associated with thrombosis include venous thrombosis, e.g., deep vein thrombosis; genetic thrombophilia, e.g., Factor V leiden and prothrombin thrombophilia; plurpura fulminans; acquired thrombophilia, e.g., antiphospholipid syndrome and systemic lupus erythematosus; drug induced thrombophilia; arterial thrombosis, e.g., myocardial infarction and peripheral arterial disease; thromboembolic disease, e.g., pulmonary embolus embolic and ischemic stroke; atrial fibrillation; post-surgery deep vein thrombosis; cancer thrombosis or infectious disease thrombosis.

In one embodiment, contacting the cell with the dsRNA agent inhibits the expression of F5 by at least 50%, 60%, 70%, 80%, 90%, or 95%.

In one embodiment, inhibiting expression of F5 decreases F5 protein level in serum of the subject by at least 50%, 60%, 70%, 80%, 90%, or 95%.

In one aspect, the present invention provides a method of treating a subject having a disorder that would benefit from reduction in coagulation Factor V (F5) expression. The method includes administering to the subject a therapeutically effective amount of any of the dsRNA agents of the invention or any of the pharmaceutical compositions of the invention, thereby treating the subject having the disorder that would benefit from reduction in F5 expression.

In another aspect, the present invention provides a method of preventing development of a disorder that would benefit from reduction in coagulation Factor V (F5) expression in a subject having at least one sign or symptom of a disorder who does not yet meet the diagnostic criteria for that disorder. The method includes administering to the subject a prophylactically effective amount of any of the dsRNA agents of the invention or any of the pharmaceutical compositions of the invention, thereby preventing the subject from progressing to meet the diagnostic criteria of the disorder that would benefit from reduction in F5 expression.

In one embodiment, the disorder is a coagulation Factor V-(F5)-associated disorder. In certain embodiments, the F5-associated disorder is a disorder associated with thrombosis. Non-limiting examples of disorders or diseases associated with thrombosis include venous thrombosis, e.g., deep vein thrombosis; genetic thrombophilia, e.g., Factor V leiden and prothrombin thrombophilia; plurpura fulminans; acquired thrombophilia, e.g., antiphospholipid syndrome and systemic lupus erythematosus; drug induced thrombophilia; arterial thrombosis, e.g., myocardial infarction and peripheral arterial disease; thromboembolic disease, e.g., pulmonary embolus embolic and ischemic stroke; atrial fibrillation; post-surgery deep vein thrombosis; cancer thrombosis or infectious disease thrombosis.

In one embodiment, the subject is a human.

In one embodiment, the dsRNA agent is administered to the subject at a dose of about 0.01 mg/kg to about 50 mg/kg.

In one embodiment, the dsRNA agent is administered to the subject subcutaneously.

In one embodiment, the method further comprises determining the level of F5 in a sample from the subject. In one embodiment, the level of F5 in the subject sample(s) is an F5 protein level in a blood or serum sample(s).

In certain embodiments, the methods of the invention further comprise administering to the subject an additional therapeutic agent. In certain embodiments, the additional therapeutic agent is an anticoagulant. In some embodiments, the anticoagulant includes heparin, enoxaparin (Lovenox), dalteparin (Fragmin), fondaparinux (Arixtra), warfarin (Coumadin, Jantoven), dabigatran (Pradaxa), rivaroxaban (Xarelto), apixaban (Eliquis), edoxaban (Savaysa), argatroban or any combination thereof. In some embodiments, the additional therapeutic agent includes a thrombolytic. In certain embodiments, the thrombolytic includes antistreplase (Eminase), tissue plasminogen activator (tPA), urokinase-type plasminogen activator (uPA), or any combination thereof. In some embodiments, the additional therapeutic agent is an immunosuppressant. In certain embodiments, the immunosuppressant includes corticosteroid, azathioprine, cyclosporine A, or any combination thereof. In some embodiments, the additional therapeutic agent is hormone replacement therapy. In certain embodiments, the hormone replacement therapy includes estrogen, gestagen, androgen or any combination thereof. In some embodiments, the additional therapeutic agent is an antibiotic. In some embodiments, the additional therapeutic agent is an antihistamine agent. In some embodiments, the additional therapeutic agent is a mast cell stabilizer. In certain embodiments, the mast cell stabilizer includes cromoglicic acid (Cromolyn), lodoxamide (Alomide), or any combination thereof. In some embodiments, the additional therapeutic agent is an anti-proliferative agent. In some embodiments, the additional therapeutic agent is an oral contraceptive. In some embodiments, the additional therapeutic agent is a fresh frozen plasma or a plasminogen concentrate. In some embodiments, the additional therapeutic agent is hyaluronidase. In some embodiments, the additional therapeutic agent is alpha chymotrypsin. In certain embodiment, the additional therapeutic agent is a filter inserted into a large vein that prevents clots that break loose from lodging in the patient's lungs. In certain embodiments, the additional therapeutic agent is selected from the group consisting of an anticoagulant, an F5 inhibitor and a thrombin inhibitor.

The invention also provides uses of the dsRNA agents and the pharmaceutical compositions provided herein for treatment of an F5-associated disorder. In certain embodiments, the uses include any of the methods provided by the invention.

The invention provides kits or pharmaceutical compositions comprising a dsRNA agent of the invention. In certain embodiments, the invention provides kits for practicing a method of the invention.

The present invention further provides an RNA-induced silencing complex (RISC) comprising an antisense strand of any of the dsRNA agents of the invention.

DETAILED DESCRIPTION OF THE INVENTION

Figure 1:
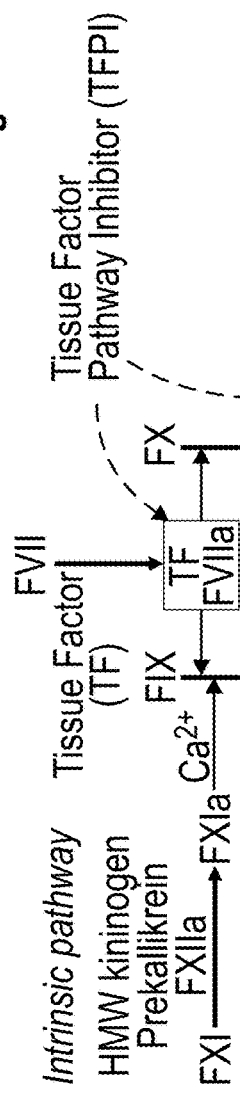
FIG. 1 is a schematic of the coagulation cascade.
Figure 1:
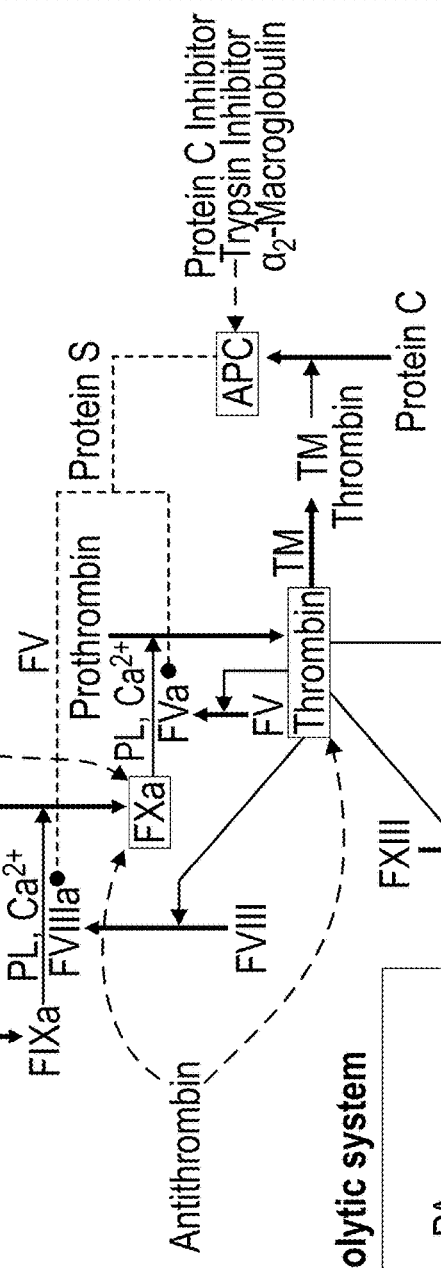
Figure 1:
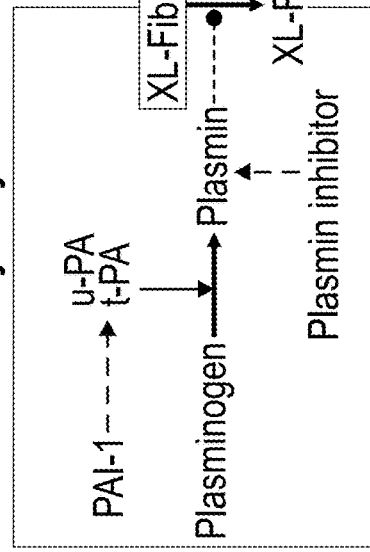
Figure 1:
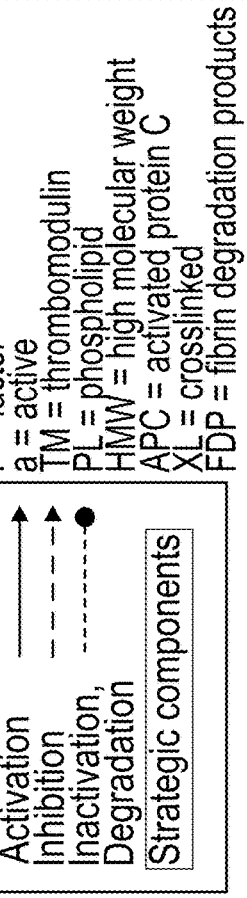

The present invention provides iRNA compositions which affect the RNA-induced silencing complex (RISC)-mediated cleavage of RNA transcripts of a coagulation Factor V (F5) gene. The gene may be within a cell, e.g., a cell within a subject, such as a human. The use of these iRNAs enables the targeted degradation of mRNAs of the corresponding gene (coagulation Factor V gene) in mammals.

The iRNAs of the invention have been designed to target the human coagulation Factor V gene, including portions of the gene that are conserved in the coagulation Factor V orthologs of other mammalian species. Without intending to be limited by theory, it is believed that a combination or sub-combination of the foregoing properties and the specific target sites or the specific modifications in these iRNAs confer to the iRNAs of the invention improved efficacy, stability, potency, durability, and safety.

Accordingly, the present invention provides methods for treating and preventing a coagulation Factor V-associated disorder, disease, or condition, e.g., a disorder, disease, or condition associated with thrombosis, e.g., venous thrombosis, e.g., deep vein thrombosis; genetic thrombophilia, e.g., Factor V leiden and prothrombin thrombophilia; plurpura fulminans; acquired thrombophilia, e.g., antiphospholipid syndrome and systemic lupus erythematosus; drug induced thrombophilia; arterial thrombosis, e.g., myocardial infarction and peripheral arterial disease; thromboembolic disease, e.g., pulmonary embolus embolic and ischemic stroke; atrial fibrillation; post-surgery deep vein thrombosis; cancer thrombosis or infectious disease thrombosis, using iRNA compositions which effect the RNA-induced silencing complex (RISC)-mediated cleavage of RNA transcripts of a coagulation Factor V gene.

The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a coagulation Factor V gene. In certain embodiments, the RNAi agents of the disclosure include an RNA strand (the antisense strand) having a region which is about 21-23 nucleotides in length, which region is substantially complementary to at least part of an mRNA transcript of a coagulation Factor V gene.

In certain embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of a coagulation Factor V gene. In some embodiments, such iRNA agents having longer length antisense strands may include a second RNA strand (the sense strand) of 20-60 nucleotides in length wherein the sense and antisense strands form a duplex of 18-30 contiguous nucleotides.

The use of iRNAs of the invention enables the targeted degradation of mRNAs of the corresponding gene (coagulation Factor V gene) in mammals. Using in vitro and in vivo assays, the present inventors have demonstrated that iRNAs targeting a coagulation Factor V gene can potently mediate RNAi, resulting in significant inhibition of expression of a coagulation Factor V gene. Thus, methods and compositions including these iRNAs are useful for treating a subject having a coagulation Factor V-associated disorder, e.g., a disorder associated with thrombosis.

Accordingly, the present invention provides methods and combination therapies for treating a subject having a disorder that would benefit from inhibiting or reducing the expression of a coagulation Factor V gene, e.g., a coagulation Factor V-associated disease, e.g., a disorder associated with thrombosis, using iRNA compositions which effect the RNA-induced silencing complex (RISC)-mediated cleavage of RNA transcripts of an F5 gene.

The present invention also provides methods for preventing at least one symptom in a subject having a disorder that would benefit from inhibiting or reducing the expression of a coagulation Factor V gene, e.g., a disorder associated with thrombosis.

The following detailed description discloses how to make and use compositions containing iRNAs to inhibit the expression of a coagulation Factor V gene as well as compositions, uses, and methods for treating subjects that would benefit from inhibition or reduction of the expression of a coagulation Factor V gene, e.g., subjects susceptible to or diagnosed with a coagulation Factor V-associated disorder, e.g., a disorder associated with thrombosis.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least", "no less than", or "or more" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "or less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a sequence and its indicated site on a transcript or other sequence, the nucleotide sequence recited in the specification takes precedence.

As used herein, the term "coagulation Factor V," used interchangeably with the term "F5," refers to the well-known gene and polypeptide, also known in the art as Factor V leiden; activated protein C cofactor; coagulation Factor V jinjiang A2 domain; proaccelerin; labile factor; PCCF; RPRGL1; and THPH2.

The F5 gene encodes an essential cofactor of the blood coagulation cascade. This factor synthesis occurs primarily in the liver. This factor circulates in plasma, and is converted to the active form by the release of the activation peptide by thrombin during coagulation. This generates a heavy chain and a light chain which are held together by calcium ions. The activated protein is a cofactor that participates with activated coagulation factor X to activate prothrombin to thrombin.

The term "F5" includes human F5, the amino acid and nucleotide sequence of which may be found in, for example, GenBank Accession Nos. NM_000130.4 (SEQ ID NO: 1); mouse F5, the amino acid and nucleotide sequence of which may be found in, for example, GenBank Accession No. NM_007976.3 (SEQ ID NO:2); rat F5, the amino acid and nucleotide sequence of which may be found in, for example, GenBank Accession No. NM_001047878.1 (SEQ ID NO: 3); and *Macaca fascicularis* F5, the amino acid and nucleotide sequence of which may be found in, for example, GenBank Accession Nos. XM_005539935.2 (SEQ ID NO: 4). Additional examples of F5 mRNA sequences are readily available using, e.g., GenBank, UniProt, OMIM, and the *Macaca* genome project web site.

Exemplary F5 nucleotide sequences may also be found in SEQ ID NOs:1-4. SEQ ID NOs:5-8 are the antisense sequences of SEQ ID NOs: 1-4, respectively.

The term "F5," as used herein, also refers to naturally occurring DNA sequence variations of the F5 gene. The term"F5," as used herein, also refers to single nucleotide polymorphisms in the F5 gene. Numerous sequence variations within the F5 gene have been identified and may be found at, for example, NCBI dbSNP and UniProt (see, e.g., www.ncbi.nlm.nih.gov/snp?LinkName=gene_snp&from_uid=2153 (which is incorporated herein by reference as of the date of filing this application) which provide a list of SNPs in human F5). In some embodiments, such naturally occurring variants are included within the scope of the F5 gene sequence.

Further information on F5 can be found, for example, at www.ncbi.nlm.nih.gov/gene/2153 (which is incorporated herein by reference as of the date of filing this application).

The entire contents of each of the foregoing GenBank Accession numbers and the Gene database numbers are incorporated herein by reference as of the date of filing this application.

As used herein, "target sequence" refers to a contiguous portion of the nucleotide sequence of an mRNA molecule formed during the transcription of a coagulation Factor V gene, including mRNA that is a product of RNA processing of a primary transcription product. The target portion of the sequence will be at least long enough to serve as a substrate for iRNA-directed cleavage at or near that portion of the nucleotide sequence of an mRNA molecule formed during the transcription of an F5 gene. In one embodiment, the target sequence is within the protein coding region of F5.

The target sequence may be from about 19-36 nucleotides in length, e.g., about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In some embodiments, the target sequence is about 19 to about 30 nucleotides in length. In other embodiments, the target sequence is about 19 to about 25 nucleotides in length. In still other embodiments, the target sequence is about 19 to about 23 nucleotides in length. In some embodiments, the target sequence is about 21 to about 23 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (sec, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a coagulation Factor V gene in a cell, e.g., a cell within a subject, such as a mammalian subject.

In one embodiment, an RNAi agent of the invention includes a single stranded RNA that interacts with a target RNA sequence, e.g., a coagulation Factor V target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107: 309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., a coagulation Factor V (F5) gene. Accordingly, the term "siRNA" is also used herein to refer to an iRNA as described above.

In certain embodiments, the RNAi agent may be a single-stranded siRNA (ssRNAi) that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In certain embodiments, an "iRNA" for use in the compositions, uses, and methods of the invention is a double stranded RNA and is referred to herein as a "double stranded RNA agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a coagulation Factor V (F5) gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

In certain embodiments of the instant disclosure, inclusion of a deoxy-nucleotide—which is acknowledged as a naturally occurring form of nucleotide—if present within a RNAi agent can be considered to constitute a modified nucleotide.

The duplex region may be of any length that permits specific degradation of a desired target RNA through a RISC pathway, and may range from about 19 to 36 base pairs in length, e.g., about 19-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

In certain embodiment, the two strands of double-stranded oligomeric compound can be linked together. The two strands can be linked to each other at both ends, or at one end only. By linking at one end is meant that 5'-end of first strand is linked to the 3'-end of the second strand or 3'-end of first strand is linked to 5'-end of the second strand. When the two strands are linked to each other at both ends, 5'-end of first strand is linked to 3'-end of second strand and 3'-end of first strand is linked to 5'-end of second strand. The two strands can be linked together by an oligonucleotide linker including, but not limited to, (N)n; wherein N is independently a modified or unmodified nucleotide and n is 3-23. In some embodiments, n is 3-10, e.g., 3, 4, 5, 6, 7, 8, 9, or 10. In some embodiments, the oligonucleotide linker is selected from the group consisting of GNRA, (G)4, (U)4, and (dT)4, wherein N is a modified or unmodified nucleotide and R is a modified or unmodified purine nucleotide. Some of the nucleotides in the linker can be involved in base-pair interactions with other nucleotides in the linker. The two strands can also be linked together by a non-nucleosidic linker, e.g. a linker described herein. It will be appreciated by one of skill in the art that any oligonucleotide chemical modifications or variations describe herein can be used in the oligonucleotide linker.

Hairpin and dumbbell type oligomeric compounds will have a duplex region equal to or at least 14, 15, 15, 16, 17, 18, 19, 29, 21, 22, 23, 24, or 25 nucleotide pairs. The duplex region can be equal to or less than 200, 100, or 50, in length. In some embodiments, ranges for the duplex region are 15-30, 17 to 23, 19 to 23, and 19 to 21 nucleotides pairs in length.

The hairpin oligomeric compounds can have a single strand overhang or terminal unpaired region, in some embodiments at the 3', and in some embodiments on the antisense side of the hairpin. In some embodiments, the overhangs are 1-4, more generally 2-3 nucleotides in length. The hairpin oligomeric compounds that can induce RNA interference are also referred to as "shRNA" herein.

Where the two substantially complementary strands of a dsRNA are comprised by separate RNA molecules, those molecules need not be, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, an iRNA agent of the invention is a dsRNA, each strand of which comprises 19-23 nucleotides, that interacts with a target RNA sequence, e.g., a coagulation Factor V (F5) gene, to direct cleavage of the target RNA.

In some embodiments, an iRNA of the invention is a dsRNA of 24-30 nucleotides that interacts with a target RNA sequence, e.g., an F5 target mRNA sequence, to direct the cleavage of the target RNA.

As used herein, the term "nucleotide overhang" refers to at least one unpaired nucleotide that protrudes from the duplex structure of a double stranded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA.

In one embodiment of the dsRNA, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotides, e.g., a 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, 10-25 nucleotides, 10-20 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the extended overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNA agent, i.e., no nucleotide overhang. A "blunt ended" double stranded RNA agent is double stranded over its entire length, i.e., no nucleotide overhang at either end of the molecule.

The RNAi agents of the invention include RNAi agents with no nucleotide overhang at one end (i.e., agents with one overhang and one blunt end) or with no nucleotide overhangs at either end. Most often such a molecule will be double-stranded over its entire length.

The term "antisense strand" or "guide strand" refers to the strand of an iRNA, e.g., a dsRNA, which includes a region that is substantially complementary to a target sequence, e.g., an F5 mRNA.

As used herein, the term "region of complementarity" refers to the region on the antisense strand that is substantially complementary to a sequence, for example a target sequence, e.g., a coagulation Factor V nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(es) is not in the seed region.

Thus, an RNAi agent as described herein can contain one or more mismatches to the target sequence. In one embodiment, a RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of an F5 gene, generally does not contain any mismatch within the central 13 nucleotides. The methods described herein or methods known in the art can be used to determine whether an RNAi agent containing a mismatch to a target sequence is effective in inhibiting the expression of an F5 gene. Consideration of the efficacy of RNAi agents with mismatches in inhibiting expression of an F5 gene is important, especially if the particular region of complementarity in an F5 gene is known to have polymorphic sequence variation within the population.

The term "sense strand" or "passenger strand" as used herein, refers to the strand of an iRNA that includes a region that is substantially complementary to a region of the antisense strand as that term is defined herein.

As used herein, "substantially all of the nucleotides are modified" is intended to include dsRNA agents of the invention in which the sense and/or antisense strands are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can be, for example, "stringent conditions", where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogsteen base pairing.

The terms "complementary," "fully complementary" and "substantially complementary" herein can be used with respect to the base matching between the sense strand and the antisense strand of a dsRNA, or between two oligonucleotides or polynucleotides, such as the antisense strand of a double stranded RNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a coagulation Factor V gene). For example, a polynucleotide is complementary to at least a part of a coagulation Factor V mRNA if the sequence is substantially complementary to a non-interrupted portion of an mRNA encoding a coagulation Factor V gene.

Accordingly, in some embodiments, the antisense polynucleotides disclosed herein are fully complementary to the target F5 sequence.

In other embodiments, the antisense polynucleotides disclosed herein are substantially complementary to the target F5 sequence and comprise a contiguous nucleotide sequence which is at least 80% complementary over its entire length to the equivalent region of the nucleotide sequence of any one of SEQ ID NOs: 1-4, or a fragment of any one of SEQ ID NOs: 1-4, such as about 85%, about 90%, about 91%, about 92%, about 93%, about 94%, about 95%, about 96%, about 97%, about 98%, or about 99% complementary.

In other embodiments, the antisense polynucleotides disclosed herein are substantially complementary to the target F5 sequence and comprise a contiguous nucleotide sequence which is at least about 80% complementary over its entire length to any one of the sense strand nucleotide sequences in any one of any one of Tables 2, 3, 5, 6-8, 10 and 11, or a fragment of any one of the sense strand nucleotide sequences in any one of Tables 2, 3, 5, 6-8, 10 and 11, such as about 85%, about 90%, about 95%, or fully complementary.

In some embodiments, the antisense polynucleotides disclosed herein are substantially complementary to the target F5 sequence and comprise a contiguous nucleotide sequence which is at least about 80% complementary over its entire length to a fragment of SEQ ID NO: 1 selected from the group of nucleotides 640-668; 747-771; 755-784; 830-855; 1226-1262; 3351-3380; 5821-5858; 5874-5910; 6104-6149; and 6245-6277 of SEQ ID NO: 1, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to the target F5 sequence and comprise a contiguous nucleotide sequence which is at least about 80% complementary over its entire length to a fragment of SEQ ID NO: 1 selected from the group of nucleotides 643-665; 645-667; 346-368; 5830-5852; 6104-6126; 6909-6931; and 1104-1126 of SEQ ID NO: 1, such as about 85%, about 90%, about 91%, about 92%, about 93%, about 94%, about 95%, about 96%, about 97%, about 98%, or about 99% complementary.

In one embodiment, an RNAi agent of the disclosure includes a sense strand that is substantially complementary to an antisense polynucleotide which, in turn, is the same as a target F5 sequence, and wherein the sense strand polynucleotide comprises a contiguous nucleotide sequence which is at least about 80% complementary over its entire length to the equivalent region of the nucleotide sequence of SEQ ID NOs: 5-8, or a fragment of any one of SEQ ID NOs: 5-8, such as about 85%, about 90%, about 95%, or fully complementary.

In some embodiments, an iRNA of the invention includes a sense strand that is substantially complementary to an antisense polynucleotide which, in turn, is complementary to a target coagulation Factor V sequence, and wherein the sense strand polynucleotide comprises a contiguous nucleotide sequence which is at least about 80% complementary over its entire length to any one of the antisense strand nucleotide sequences in any one of any one of Tables 2, 3, 5, 6-8, 10 and 11, or a fragment of any one of the antisense strand nucleotide sequences in any one of Tables 2, 3, 5, 6-8, 10 and 11, such as about 85%, about 90%, about 95%, or fully complementary.

In certain embodiments, the sense and antisense strands are selected from any one of duplexes AD-109630; AD-1465920; AD-1465922; AD-1615171; AD-1615234; AD-1615253; AD-1615278; and AD-1615312.

In some embodiments, the double-stranded region of a double-stranded iRNA agent is equal to or at least, 17, 18, 19, 20, 21, 22, 23, 23, 24, 25, 26, 27, 28, 29, 30 or more nucleotide pairs in length.

In some embodiments, the antisense strand of a double-stranded iRNA agent is equal to or at least 17, 18, 19, 20, 21, 22, 23, 23, 24, 25, 26, 27, 28, 29, or 30 nucleotides in length.

In some embodiments, the sense strand of a double-stranded iRNA agent is equal to or at least 17, 18, 19, 20, 21, 22, 23, 23, 24, 25, 26, 27, 28, 29, or 30 nucleotides in length.

In one embodiment, the sense and antisense strands of the double-stranded iRNA agent are each 18 to 30 nucleotides in length.

In one embodiment, the sense and antisense strands of the double-stranded iRNA agent are each 19 to 25 nucleotides in length.

In one embodiment, the sense and antisense strands of the double-stranded iRNA agent are each 21 to 23 nucleotides in length.

In one embodiment, the sense strand of the iRNA agent is 21-nucleotides in length, and the antisense strand is 23-nucleotides in length, wherein the strands form a double-stranded region of 21 consecutive base pairs having a 2-nucleotide long single stranded overhangs at the 3'-end.

In some embodiments, the majority of nucleotides of each strand are ribonucleotides, but as described in detail herein, each or both strands can also include one or more non-ribonucleotides, e.g., a deoxyribonucleotide or a modified nucleotide. In addition, an "iRNA" may include ribonucleotides with chemical modifications. Such modifications may include all types of modifications disclosed herein or known in the art. Any such modifications, as used in an iRNA molecule, are encompassed by "iRNA" for the purposes of this specification and claims.

In certain embodiments of the instant disclosure, inclusion of a deoxy-nucleotide if present within an RNAi agent can be considered to constitute a modified nucleotide.

In one embodiment, at least partial suppression of the expression of an F5 gene, is assessed by a reduction of the amount of F5 mRNA which can be isolated from or detected in a first cell or group of cells in which an F5 gene is transcribed and which has or have been treated such that the expression of an F5 gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \cdot 100\%$$

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a rabbit, a sheep, a hamster, a guinea pig, a dog, a rat, or a mouse), or a bird that expresses the target gene, either endogenously or heterologously. In an embodiment, the subject is a human, such as a human being treated or assessed for a disease or disorder that would benefit from reduction in F5 expression; a human at risk for a disease or disorder that would benefit from reduction in F5 expression; a human having a disease or disorder that would benefit from reduction in F5 expression; or human being treated for a disease or disorder that would benefit from reduction in F5 expression as described herein. In some embodiments, the subject is a female human. In other embodiments, the subject is a male human. In one embodiment, the subject is an adult subject. In another embodiment, the subject is a pediatric subject.

As used herein, the terms "treating" or "treatment" refer to a beneficial or desired result, such as reducing at least one sign or symptom of an F5-associated disorder in a subject. Treatment also includes a reduction of one or more sign or symptoms associated with unwanted F5 expression; diminishing the extent of unwanted F5 activation or stabilization; amelioration or palliation of unwanted F5 activation or stabilization. "Treatment" can also mean prolonging survival as compared to expected survival in the absence of treatment. In certain embodiments, the F5-associated disease or disorder is a disease or disorder associated with thrombosis. Non-limiting examples of disorders or diseases associated with thrombosis include venous thrombosis, e.g., deep vein thrombosis; genetic thrombophilia, e.g., Factor V leiden and prothrombin thrombophilia; plurpura fulminans; acquired thrombophilia, e.g., antiphospholipid syndrome and systemic lupus erythematosus; drug induced thrombophilia; arterial thrombosis, e.g., myocardial infarction and peripheral arterial disease; thromboembolic disease, e.g., pulmonary embolus embolic and ischemic stroke; atrial fibrillation; post-surgery deep vein thrombosis; cancer thrombosis or infectious disease thrombosis.

The term "lower" in the context of the level of F5 in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of F5 in a subject is a decrease to a level accepted as within the range of normal for an individual without such disorder. In certain embodiments, the expression of the target is normalized, i.e., decreased towards or to a level accepted as within the range of normal for an individual without such disorder. As used here, "lower" in a subject can refer to lowering of gene expression or protein production in a cell in a subject does not require lowering of expression in all cells or tissues of a subject. For example, as used herein, lowering in a subject can include lowering of gene expression or protein production in the liver of a subject.

The term "lower" can also be used in association with normalizing a symptom of a disease or condition, i.e. decreasing the difference between a level in a subject suffering from an F5-associated disease towards or to a level in a normal subject not suffering from an F5-associated disease.

As used herein, if a disease is associated with an elevated value for a symptom, "normal" is considered to be the upper limit of normal. If a disease is associated with a decreased value for a symptom, "normal" is considered to be the lower limit of normal.

As used herein, "prevention" or "preventing," when used in reference to a disease, disorder or condition thereof, that would benefit from a reduction in expression of an F5 gene or production of F5 protein, refers to preventing a subject who has at least one sign or symptom of a disease from developing further signs and symptoms thereby meeting the diagnostic criteria for that disease. In certain embodiments, prevention includes delayed progression to meeting the diagnostic criteria of the disease by days, weeks, months or years as compared to what would be predicted by natural history studies or the typical progression of the disease.

As used herein, the terms "coagulation Factor V-associated disease" or "F5-associated disease," include a disease, disorder or condition that would benefit from a decrease in F5 gene expression, replication, or protein activity. Such disorders are caused by, or associated with excessive blood clotting. In some embodiments, the F5-associated disease or disorder is a disease or disorder associated with thrombosis. Non-limiting examples of disorders or diseases associated with thrombosis include venous thrombosis, e.g., deep vein thrombosis; genetic thrombophilia, e.g., Factor V leiden and prothrombin thrombophilia; plurpura fulminans; acquired thrombophilia, e.g., antiphospholipid syndrome and systemic lupus erythematosus; drug induced thrombophilia; arterial thrombosis, e.g., myocardial infarction and peripheral arterial disease; thromboembolic disease, e.g., pulmonary embolus embolic and ischemic stroke; atrial fibrillation; post-surgery deep vein thrombosis; cancer thrombosis or infectious disease thrombosis.

"Therapeutically effective amount," as used herein, is intended to include the amount of an RNAi agent that, when administered to a subject having an F5-associated disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an RNAi agent that, when administered to a subject having at least one sign or symptom of an F5-associated disorder, is sufficient to prevent or delay the subject's progression to meeting the full diagnostic criteria of the disease. Prevention of the disease includes slowing the course of progression to full blown disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired effect at a reasonable benefit/risk ratio applicable to any treatment. The iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Such carriers are known in the art. Pharmaceutically acceptable carriers include carriers for administration by injection.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to urine obtained from the subject. A "sample derived from a subject" can refer to blood or blood derived serum or plasma from the subject.

II. iRNAs of the Invention

The present invention provides iRNAs which inhibit the expression of a coagulation Factor V gene. In certain embodiments, the iRNA includes double stranded ribonucleic acid (dsRNA) molecules for inhibiting the expression of an F5 gene in a cell, such as a cell within a subject, e.g., a mammal, such as a human susceptible to developing a coagulation Factor V-associated disorder. The dsRNAi agent includes an antisense strand having a region of complementarity which is complementary to at least a part of an mRNA formed in the expression of an F5 gene. The region of complementarity is about 19-30 nucleotides in length (e.g., about 30, 29, 28, 27, 26, 25, 24, 23, 22, 21, 20, or 19 nucleotides in length). Upon contact with a cell expressing the F5 gene, the iRNA inhibits the expression of the F5 gene (e.g., a human, a primate, a non-primate, or a rat F5 gene) by at least about 50% as assayed by, for example, a PCR or branched DNA (bDNA)-based method, or by a protein-based method, such as by immunofluorescence analysis, using, for example, western blotting or flow cytometric techniques. In some embodiments, inhibition of expression is determined by the qPCR method provided in the examples herein with the siRNA at, e.g., a 10 nM concentration, in an appropriate organism cell or cell line provided therein. In some embodiments, inhibition of expression in vivo is determined by knockdown of the human gene in a rodent expressing the human gene, e.g., a mouse or an AAV-infected mouse expressing the human target gene, e.g., when administered as single dose, e.g., at 3 mg/kg at the nadir of RNA expression.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an F5 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is about 19 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 19 to about 30 base pairs, e.g., about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target coagulation Factor V gene expression is not generated in the target cell by cleavage of a larger dsRNA.

A dsRNA as described herein can further include one or more single-stranded nucleotide overhangs e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

Regardless of the method of synthesis, the siRNA preparation can be prepared in a solution (e.g., an aqueous or organic solution) that is appropriate for formulation. For example, the siRNA preparation can be precipitated and redissolved in pure double-distilled water, and lyophilized. The dried siRNA can then be resuspended in a solution appropriate for the intended formulation process.

In an aspect, a dsRNA of the invention includes at least two nucleotide sequences, a sense sequence and an antisense sequence. The sense strand is selected from the group of sequences provided in any one of Tables 2, 3, 5, 6-8, 10 and 11, and the corresponding antisense strand of the sense strand is selected from the group of sequences of any one of Tables 2, 3, 5, 6-8, 10 and 11. In this aspect, one of the two sequences is complementary to the other of the two sequences, with one of the sequences being substantially complementary to a sequence of an mRNA generated in the expression of a coagulation Factor V gene. As such, in this aspect, a dsRNA will include two oligonucleotides, where one oligonucleotide is described as the sense strand in any one of Tables 2, 3, 5, 6-8, 10 and 11, and the second oligonucleotide is described as the corresponding antisense strand of the sense strand in any one of Tables 2, 3, 5, 6-8, 10 and 11.

In certain embodiments, the substantially complementary sequences of the dsRNA are contained on separate oligonucleotides. In other embodiments, the substantially complementary sequences of the dsRNA are contained on a single oligonucleotide.

In certain embodiments, the sense and antisense strand is selected from the sense or antisense strand of any one of duplexes AD-109630; AD-1465920; AD-1465922; AD-1615171; AD-1615234; AD-1615253; AD-1615278; and AD-1615312.

It will be understood that, although the sequences in Tables 2, 5, 7 and 10 are not described as modified or conjugated sequences, the RNA of the iRNA of the invention e.g., a dsRNA of the invention, may comprise any one of the sequences set forth in any one of Tables 2, 3, 5, 6-8, 10 and 11 that is un-modified, un-conjugated, or modified or conjugated differently than described therein. In other words, the invention encompasses dsRNA of any one of Tables 2, 3, 5, 6-8, 10 and 11 which are un-modified, un-conjugated, modified, or conjugated, as described herein.

The skilled person is well aware that dsRNAs having a duplex structure of about 20 to 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 2, 3, 5, 6-8, 10 and 11, dsRNAs described herein can include at least one strand of a length of minimally 21 nucleotides. It can be reasonably expected that shorter duplexes having any one of the sequences in any one of Tables 2, 3, 5, 6-8, 10 and 11 minus only a few nucleotides on one or both ends can be similarly effective as compared to the dsRNAs described above. Hence, dsRNAs having a sequence of at least 19, 20, or more contiguous nucleotides derived from any one of the sequences of any one of Tables 2, 3, 5, 6-8, 10 and 11, and differing in their ability to inhibit the expression of a coagulation Factor V gene by not more than about 5, 10, 15, 20, 25, or 30% inhibition from a dsRNA comprising the full sequence, are contemplated to be within the scope of the present invention.

In addition, the RNAs provided in any one of Tables 2, 3, 5, 6-8, 10 and 11 identify a site(s) in a coagulation Factor V transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 19 contiguous nucleotides from any one of the sequences provided in any one of Tables 2, 3, 5, 6-8, 10 and 11 coupled to additional nucleotide sequences taken from the region contiguous to the selected sequence in a coagulation Factor V gene.

An RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of an F5 gene generally does not contain any mismatch within the central 13 nucleotides. The methods described herein or methods known in the art can be used to determine whether an RNAi agent containing a mismatch to a target sequence is effective in inhibiting the expression of an F5 gene. Consideration of the efficacy of RNAi agents with mismatches in inhibiting expression of an F5 gene is important, especially if the particular region of complementarity in an F5 gene is known to have polymorphic sequence variation within the population.

III. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester or phosphorothioate groups present in the agent. Agents in which substantially all of the phosphodiester or phosphorothioate linkages have a sodium counterion include not more than 5, 4, 3, 2, or 1 phosphodiester or phosphorothioate linkages without a sodium counterion. In some embodiments, when the dsRNA agents of the invention are in the sodium salt form, sodium ions are present in the agent as counterions for all of the phosphodiester or phosphorothioate groups present in the agent.

Representative U.S. patents that teach the preparation of the above phosphorus-containing linkages include, but are not limited to, U.S. Pat. Nos. 3,687,808; 4,469,863; 4,476, 301; 5,023,243; 5,177,195; 5,188,897; 5,264,423; 5,276, 019; 5,278,302; 5,286,717; 5,321,131; 5,399,676; 5,405, 939; 5,453,496; 5,455,233; 5,466,677; 5,476,925; 5,519, 126; 5,536,821; 5,541,316; 5,550,111; 5,563,253; 5,571, 799; 5,587,361; 5,625,050; 6,028,188; 6,124,445; 6,160, 109; 6,169,170; 6,172,209; 6,239,265; 6,277,603; 6,326, 199; 6,346,614; 6,444,423; 6,531,590; 6,534,639; 6,608, 035; 6,683,167; 6,858,715; 6,867,294; 6,878,805; 7,015, 315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methylenimino and methylenehydrazino backbones; sulfonate and sulfonamide backbones; amide backbones; and others having mixed N, O, S, and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., Science, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P—O—$CH_2$— ] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)·_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCH_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxythimidine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, cd. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T, and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° ° C. (Sanghvi, Y. S., Crooke, S. T, and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12): 3185-3193).

In some embodiments, the RNA of an iRNA can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH$_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH$_2$)—O-2' (LNA); 4'-(CH$_2$)—S-2'; 4'-(CH$_2$)$_2$—O-2' (ENA); 4'-CH(CH$_3$)—O-2' (also referred to as "constrained ethyl" or "cEt") and 4'-CH(CH$_2$OCH$_3$)—O-2' (and analogs thereof; sec, e.g., U.S. Pat. No. 7,399,845); 4'-C(CH$_3$)(CH$_3$)—O-2' (and analogs thereof; see e.g., U.S. Pat. No. 8,278,283); 4'-CH$_2$—N (OCH$_3$)-2' (and analogs thereof; see e.g., U.S. Pat. No. 8,278,425); 4'-CH$_2$—O—N(CH$_3$)-2' (sec, e.g., U.S. Patent Publication No. 2004/0171570); 4'-CH$_2$—N(R)—O-2', wherein R is H, C1-C12 alkyl, or a protecting group (see, e.g., U.S. Pat. No. 7,427,672); 4'-CH$_2$—C(H)(CH$_3$)-2' (sec, e.g., Chattopadhyaya et al., *J. Org. Chem.*, 2009, 74, 118-134); and 4'-CH$_2$—C(=CH$_2$)-2' (and analogs thereof; see, e.g., U.S. Pat. No. 8,278,426). The entire contents of each of the foregoing are hereby incorporated herein by reference.

Additional representative U.S. patents and U.S. patenttent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH (CH$_3$)—O-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US2013/0190383; and WO2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons).

In another example, the C2'-C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.,* 2009, 10, 1039 hereby incorporated by reference).

Representative U.S. publications that teach the preparation of UNA include, but are not limited to, U.S. Pat. No. 8,314,227; and US2013/0096289; US2013/0011922; and US2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in WO2011/005861.

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example US2012/0157511, the entire contents of which are incorporated herein by reference.

A. Modified iRNAs Comprising Motifs of the Invention

In certain aspects of the invention, the double stranded RNA agents of the invention include agents with chemical modifications as disclosed, for example, in WO2013/075035, the entire contents of each of which are incorporated herein by reference. WO2013/075035 provides motifs of three identical modifications on three consecutive nucleotides into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNA agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNA agents capable of inhibiting the expression of a target gene (i.e., F5 gene) in vivo. The RNAi agent comprises a sense strand and an antisense strand. Each strand of the RNAi agent may be, for example, 17-30 nucleotides in length, 25-30 nucleotides in length, 27-30 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be, for example, the duplex region can be 27-30 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 19, 20, 21, 22, 23, 24, 25, 26, and 27 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (or the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In other embodiments, the dsRNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet other embodiments, the dsRNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. In some embodiments, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif. Optionally, the dsRNAi agent further comprises a ligand (e.g., GalNAc).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 19-23 nucleotides in length, the cleavage site of the antisense strand is typically around the 10, 11, and 12 positions from the 5'-end. Thus the motifs of three identical modifications may occur at the 9, 10, 11 positions; the 10, 11, 12 positions; the 11, 12, 13 positions; the 12, 13, 14 positions; or the 13, 14, 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, CET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A. B and C each represent one type of modification to the nucleotide, the alternating motif can be "ABABABABABAB . . . ." "AAB-BAABBAABB . . . ." "AABAABAABAAB . . . ." "AAA-BAAABAAAB . . . ." "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDCDCD . . . ." etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ." where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5'end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxythimidine (dT) or the nucleotide at the 3'-end of the antisense strand is deoxythimidine (dT). For example, there is a short sequence of deoxythimidine nucleotides, for example, two dT nucleotides on the 3'-end of the sense, antisense strand, or both strands.

In certain embodiments, the sense strand sequence may be represented by formula (I):

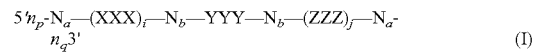

$$5'n_p\text{-}N_a\text{—}(XXX)_i\text{—}N_b\text{—}YYY\text{—}N_b\text{—}(ZZZ)_j\text{—}N_a\text{-}n_q3' \qquad (I)$$

wherein:
i and j are each independently 0 or 1;
p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein Nb and Y do not have the same modification; and

XXX, YYY, and ZZZ each independently represent one motif of three identical modifications on three consecutive nucleotides. In some embodiments, YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

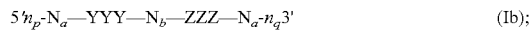  (Ib);

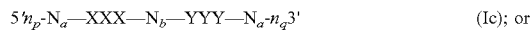  (Ic); or

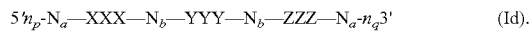  (Id).

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. In some embodiments, $N_b$ is 0, 1, 2, 3, 4, 5, or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

  (Ia).

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

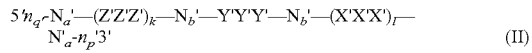  (II)

wherein
k and l are each independently 0 or 1;
p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. In some embodiments, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

  (IIb);

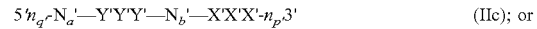  (IIc); or

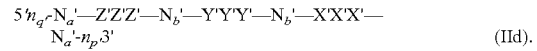  (IId).

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. In some embodiments, $N_b$ is 0, 1, 2, 3, 4, 5, or 6.

In other embodiments, k is 0 and l is 0 and the antisense strand may be represented by the formula:

  (Ia).

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

sense: 5' $n_p$-$N_a$—(XXX)$_i$—$N_b$—YYY—$N_b$—(ZZZ)$_j$—$N_a$-$n_q$3' antisense: 3' $n_p'$-$N_a'$—(X'X'X')$_k$—$N_b'$—Y'Y'Y'—$N_b'$—(Z'Z'Z')$_l$—$N_a'$-$n_q'$5'  (III)

wherein:
i, j, k, and l are each independently 0 or 1;
p, p', q, and q' are each independently 0-6;
each $N_a$ and $N_a'$ independently represents an oligonucleotide sequence comprising 0-25 modified nucleotides, each sequence comprising at least two differently modified nucleotides;
each $N_b$ and $N_b'$ independently represents an oligonucleotide sequence comprising 0-10 modified nucleotides;
wherein each $n_p'$, $n_p$, $n_q'$, and $n_q$, each of which may or may not be present, independently represents an overhang nucleotide; and
XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an iRNA duplex include the formulas below:

5' $n_p$-$N_a$—YYY—$N_a$-$n_q$3'

3' $n_p'$-$N_a'$—Y'Y'Y'—$N_a'$-$n_q'$5'  (IIIa)

5' $n_p$-$N_a$—YYY—$N_b$—ZZZ—$N_a$-$n_q$3'

3' $n_p'$-$N_a'$—Y'Y'Y'—$N_b'$—Z'Z'Z'—$N_a'$-$n_q'$5'  (IIIb)

5' $n_p$-$N_a$—XXX—$N_b$—YYY—$N_a$-$n_q$3'

3' $n_p'$-$N_a'$—X'X'X'—$N_b'$—Y'Y'Y'—$N_a'$-$n_q'$5'  (IIIc)

5' $n_p$-$N_a$—XXX—$N_b$—YYY—$N_b$—ZZZ—$N_a$-$n_q$3'

3' $n_p'$-$N_a'$—X'X'X'—$N_b'$—Y'Y'Y'—$N_b'$—Z'Z'Z'—$N_a$-$n_q$5'  (IIId)

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the dsRNAi agent is represented as formula (IIIc), each $N_b$, $N_b'$ independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b'$ independently represents an oligonucleotide sequence comprising 0-10, 0-7, 0-10, 0-7, 0-5, 0-4, 0-2, or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$, and $N_b'$ independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the $N_a$ modifications are 2'-O-methyl or 2'-fluoro modifications. In other embodiments, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

In certain embodiments, the compositions and methods of the disclosure include a vinyl phosphonate (VP) modification of an RNAi agent as described herein. In exemplary embodiments, a 5'-vinyl phosphonate modified nucleotide of the disclosure has the structure:

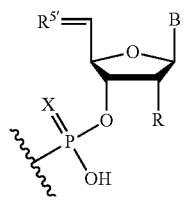

wherein X is O or S;

R is hydrogen, hydroxy, fluoro, or C1-20alkoxy (e.g., methoxy or n-hexadecyloxy);

R5' is =C(H)—P(O)(OH)2 and the double bond between the C5' carbon and R5' is in the E or Z orientation (e.g., E orientation); and B is a nucleobase or a modified nucleobase, optionally where B is adenine, guanine, cytosine, thymine, or uracil.

A vinyl phosphonate of the instant disclosure may be attached to either the antisense or the sense strand of a dsRNA of the disclosure. In certain embodiments, a vinyl phosphonate of the instant disclosure is attached to the antisense strand of a dsRNA, optionally at the 5' end of the antisense strand of the dsRNA.

Vinyl phosphonate modifications are also contemplated for the compositions and methods of the instant disclosure. An exemplary vinyl phosphonate structure includes the preceding structure, where R5' is =C(H)—OP(O)(OH)2 and the double bond between the C5' carbon and R5' is in the E or Z orientation (e.g., E orientation).

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of an iRNA can be replaced with another moiety, e.g., a non-carbohydrate (such as, cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," such as two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group. In some embodiments, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin. in some embodiments, the acyclic group is a serinol backbone or diethanolamine backbone.

i. Thermally Destabilizing Modifications

In certain embodiments, a dsRNA molecule can be optimized for RNA interference by incorporating thermally destabilizing modifications in the seed region of the antisense strand (i.e., at positions 2-9 of the 5'-end of the antisense strand or at positions 2-8 of the 5'-end of the antisense strand) to reduce or inhibit off-target gene silencing.

The term "thermally destabilizing modification (s)" includes modification(s) that would result with a dsRNA with a lower overall melting temperature (Tm) than the Tm of the dsRNA without having such modification(s). For example, the thermally destabilizing modification(s) can decrease the Tm of the dsRNA by 1-4° C., such as one, two, three or four degrees Celcius. And, the term "thermally destabilizing nucleotide" refers to a nucleotide containing one or more thermally destabilizing modifications.

It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, such as positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. In some embodiments, the thermally destabilizing modification of the duplex is located at position 2, 3, 4, 5 or 9 from the 5'-end of the antisense strand.

An iRNA agent comprises a sense strand and an antisense strand, each strand having 14 to 40 nucleotides. The RNAi agent may be represented by formula (L):

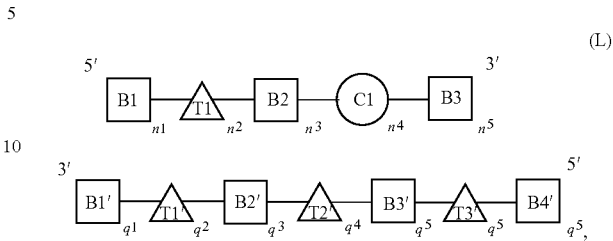

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O—N-methylacetamido (2'-O-NMA, 2'O—CH2C(O)N(Me)H) modification.

C1 is a thermally destabilizing nucleotide placed at a site opposite to the seed region of the antisense strand (i.e., at positions 2-8 of the 5'-end of the antisense strand or at positions 2-9 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In one embodiment, C1 has thermally destabilizing modification selected from the group consisting of: i) mismatch with the opposing nucleotide in the antisense strand; ii) abasic modification selected from the group consisting of:

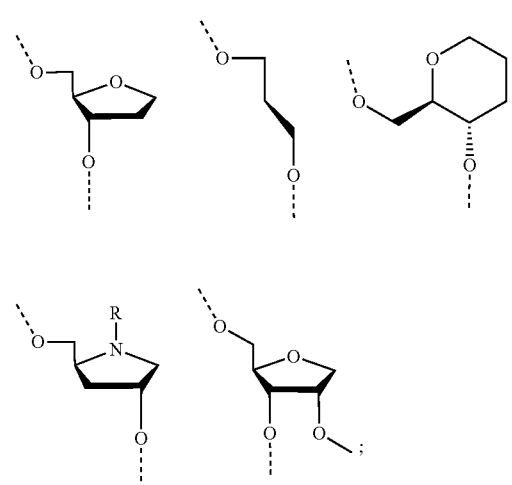

and iii) sugar modification selected from the group consisting of:

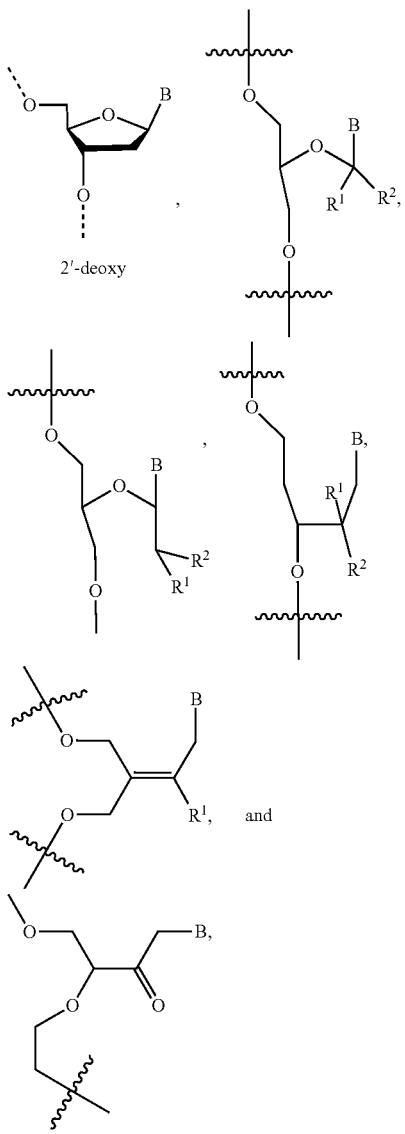

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar. In one embodiment, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

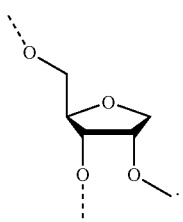

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, TI is DNA. In one embodiment, T1' is DNA, RNA or LNA. In one embodiment, T2' is DNA or RNA. In one embodiment, T3' is DNA or RNA.

$n^1$, $n^3$, and $q^1$ are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length.

Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, $q^4$, and $q^6$ are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand In one embodiment, T3' starts at position 2 from the 5' end of the antisense strand. In one example, T3' is at position 2 from the 5' end of the antisense strand and $q^6$ is equal to 1.

In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In one embodiment, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1.

In one embodiment, B1' is 2'-OMe or 2'-F, q' is 9. T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, q' is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, q' is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In one embodiment, B1 is 2'-OMe or 2'-F, $n^1$ is 8, T1 is 2'F, $n^1$ is 3, B2 is 2'-OMe, $n^3$ is 7, $n^4$ is 0, B3 is 2'-OMe, $n^5$ is 3, B1' is 2'-OMe or 2'-F, q' is 9. T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8. T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, q' is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, q' is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, q' is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9. T1' is 2'-F, $q^2$ is 1, B2' is 2'-OMe or 2'-F, $q^3$ is 4. T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, q' is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-PS$_2$), 5'-end vinylphosphonate (5'-VP), 5'-end methylphosphonate (MePhos), or 5'-deoxy-5'-C-malonyl

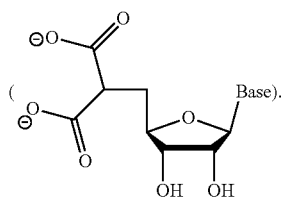

When the 5'-end phosphorus-containing group is 5'-end vinylphosphonate (5'-VP), the 5'-VP can be either 5'-E-VP isomer (i.e., trans-vinylphosphonate,

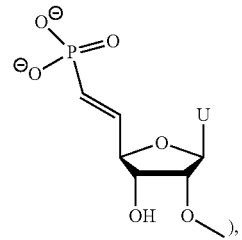

5'-Z—VP isomer (i.e., cis-vinylphosphonate,

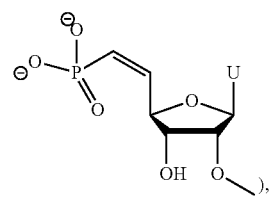

or mixtures thereof.

In one embodiment, the RNAi agent comprises a phosphorus-containing group at the 5'-end of the sense strand. In one embodiment, the RNAi agent comprises a phosphorus-containing group at the 5'-end of the antisense strand.

In one embodiment, the RNAi agent comprises a 5'-P. In one embodiment, the RNAi agent comprises a 5'-P in the antisense strand.

In one embodiment, the RNAi agent comprises a 5'-PS. In one embodiment, the RNAi agent comprises a 5'-PS in the antisense strand.

In one embodiment, the RNAi agent comprises a 5'-VP. In one embodiment, the RNAi agent comprises a 5'-VP in the antisense strand. In one embodiment, the RNAi agent comprises a 5'-E-VP in the antisense strand. In one embodiment, the RNAi agent comprises a 5'-Z—VP in the antisense strand.

In one embodiment, the RNAi agent comprises a 5'-PS$_2$. In one embodiment, the RNAi agent comprises a 5'-PS$_2$ in the antisense strand.

In one embodiment, the RNAi agent comprises a 5'-PS$_2$. In one embodiment, the RNAi agent comprises a 5'-deoxy-5'-C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, q' is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, q' is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, q' is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP. 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z—VP, or combination thereof. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3. B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNAi RNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP. 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP. 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z—VP, or combination thereof), and a targeting ligand.

In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3. B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^1$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z—VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0. B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^1$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^1$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3. B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z—VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^1$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^1$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z—VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3. B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In a particular embodiment, an RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker; and
  (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end);
and
(b) an antisense strand having:
  (i) a length of 23 nucleotides;
  (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
  (iii) phosphorothioate internucleotide linkages between nucleotide positions 21 and 22, and between nucleotide positions 22 and 23 (counting from the 5' end);
wherein the dsRNA agents have a two nucleotide overhang at the 3'-end of the antisense strand, and a blunt end at the 5'-end of the antisense strand.

In another particular embodiment, an RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
  (iv) phosphorothioate internucleotide linkages between nucleotide positions 1 and 2, and between nucleotide positions 2 and 3 (counting from the 5' end);
and
(b) an antisense strand having:
  (i) a length of 23 nucleotides;
  (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, 10, and 12 to 21, 2'-F modifications at positions 7, and 9, and a deoxy-nucleotide (e.g. dT) at position 11 (counting from the 5' end); and
  (iv) phosphorothioate internucleotide linkages between nucleotide positions 1 and 2, and between nucleotide positions 2 and 3 (counting from the 5' end);
and
(b) an antisense strand having:
  (i) a length of 23 nucleotides;
  (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, 10, 12, 14, and 16 to 21, and 2'-F modifications at positions 7, 9, 11, 13, and 15; and
  (iv) phosphorothioate internucleotide linkages between nucleotide positions 1 and 2, and between nucleotide positions 2 and 3 (counting from the 5' end);
and
(b) an antisense strand having:
  (i) a length of 23 nucleotides;
  (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 9, and 12 to 21, and 2'-F modifications at positions 10, and 11; and
  (iv) phosphorothioate internucleotide linkages between nucleotide positions 1 and 2, and between nucleotide positions 2 and 3 (counting from the 5' end);

and
(b) an antisense strand having:
   (i) a length of 23 nucleotides;
   (ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
   (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
   (i) a length of 21 nucleotides;
   (ii) an ASGPR ligand attached to the 3'-end, wherein said ASGPR ligand comprises three GalNAc derivatives attached through a trivalent branched linker;
   (iii) 2'-F modifications at positions 1, 3, 5, 7, 9 to 11, and 13, and 2'-OMe modifications at positions 2, 4, 6, 8, 12, and 14 to 21; and
   (iv) phosphorothioate internucleotide linkages between nucleotide positions 1 and 2, and between nucleotide positions 2 and 3 (counting from the 5' end);
and
(b) an antisense strand having:
   (i) a length of 23 nucleotides;
   (ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
   (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
   (i) a length of 21 nucleotides;
   (ii) an ASGPR ligand attached to the 3'-end, wherein said ASGPR ligand comprises three GalNAc derivatives attached through a trivalent branched linker;
   (iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
   (iv) phosphorothioate internucleotide linkages between nucleotide positions 1 and 2, and between nucleotide positions 2 and 3 (counting from the 5' end);
and
(b) an antisense strand having:
   (i) a length of 25 nucleotides;
   (ii) 2'-OMe modifications at positions 1, 4, 6, 7, 9, 11 to 13, 15, 17, and 19 to 23, 2'-F modifications at positions 2, 3, 5, 8, 10, 14, 16, and 18, and desoxynucleotides (e.g. dT) at positions 24 and 25 (counting from the 5' end); and
   (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a four nucleotide overhang at the 3'-end of the antisense strand, and a blunt end at the 5'-end of the antisense strand.

In another particular embodiment, a RNAi agent of the present invention comprises:
(a) a sense strand having:
   (i) a length of 21 nucleotides;
   (ii) an ASGPR ligand attached to the 3'-end, wherein said ASGPR ligand comprises three GalNAc derivatives attached through a trivalent branched linker;
   (iii) 2'-OMe modifications at positions 1 to 6, 8, and 12 to 21, and 2'-F modifications at positions 7, and 9 to 11; and
   (iv) phosphorothioate internucleotide linkages between nucleotide positions 1 and 2, and between nucleotide positions 2 and 3 (counting from the 5' end);
and
(b) an antisense strand having:
   (i) a length of 23 nucleotides;
   (ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
   (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
   (i) a length of 21 nucleotides;
   (ii) an ASGPR ligand attached to the 3'-end, wherein said ASGPR ligand comprises three GalNAc derivatives attached through a trivalent branched linker;
   (iii) 2'-OMe modifications at positions 1 to 6, 8, and 12 to 21, and 2'-F modifications at positions 7, and 9 to 11; and
   (iv) phosphorothioate internucleotide linkages between nucleotide positions 1 and 2, and between nucleotide positions 2 and 3 (counting from the 5' end);
and
(b) an antisense strand having:
   (i) a length of 23 nucleotides;
   (ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
   (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:

(a) a sense strand having:
  (i) a length of 19 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 4, 6, and 10 to 19, and 2'-F modifications at positions 5, and 7 to 9; and
  (iv) phosphorothioate internucleotide linkages between nucleotide positions 1 and 2, and between nucleotide positions 2 and 3 (counting from the 5' end);
and
(b) an antisense strand having:
  (i) a length of 21 nucleotides;
  (ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
  (iii) phosphorothioate internucleotide linkages between nucleotide positions 1 and 2, between nucleotide positions 2 and 3, between nucleotide positions 19 and 20, and between nucleotide positions 20 and 21 (counting from the 5' end);
wherein the RNAi agents have a two nucleotide overhang at the 3'-end of the antisense strand, and a blunt end at the 5'-end of the antisense strand.

In certain embodiments, the iRNA for use in the methods of the invention is an agent selected from agents listed in any one of Tables 2, 3, 5, 6-8, 10 and 11. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acid. Sci. USA*, 1989, 86: 6553-6556). In other embodiments, the ligand is cholic acid (Manoharan et al., *Biorg. Med. Chem. Let.*, 1994, 4:1053-1060), a thioether, e.g., beryl-S-tritylthiol (Manoharan et al., *Ann. N.Y. Acad. Sci.*, 1992, 660:306-309; Manoharan et al., *Biorg. Med. Chem. Let.*, 1993, 3:2765-2770), a thiocholesterol (Oberhauser et al., *Nucl. Acids Res.*, 1992, 20:533-538), an aliphatic chain, e.g., dodecandiol or undecyl residues (Saison-Behmoaras et al., *EMBO J*, 1991, 10:1111-1118; Kabanov et al., *FEBS Lett.*, 1990, 259:327-330; Svinarchuk et al., *Biochimie*, 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylaminocarbonyloxycholesterol moiety (Crooke et al., *J. Pharmacol. Exp. Ther.*, 1996, 277:923-937).

In certain embodiments, a ligand alters the distribution, targeting, or lifetime of an iRNA agent into which it is incorporated. In certain embodiments a ligand provides an enhanced affinity for a selected target, e.g., molecule, cell or cell type, compartment, e.g., a cellular or organ compartment, tissue, organ or region of the body, as, e.g., compared to a species absent such a ligand. In some embodiments, ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A. Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxol, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins, etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other methods for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. Such a lipid or lipid-based molecule may bind a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. In some embodiments, it binds HSA with a sufficient affinity such that the conjugate will be distributed to a non-kidney tissue. However, it is preferred that the affinity not be so strong that the HSA-ligand binding cannot be reversed.

In other embodiments, the lipid based ligand binds HSA weakly or not at all, such that the conjugate will be distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, such as a helical cell-permeation agent. In some embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. In some embodiments, the helical agent is an alpha-helical agent, which has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 25). An RFGF analogue (e.g., amino acid sequence AALLPVLLAAP (SEQ ID NO:26) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:27) and the *Drosophila* Antennapedia protein (RQIKIWFQNRRMKWKK (SEQ ID NO:28) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidomimetics may include D-amino acids, as well as synthetic RGD mimics. In addition to RGD, one can use other moieties that target the integrin ligand, such as PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simconi et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In one embodiment, a carbohydrate conjugate for use in the compositions and methods of the invention is selected from the group consisting of:
Formula II
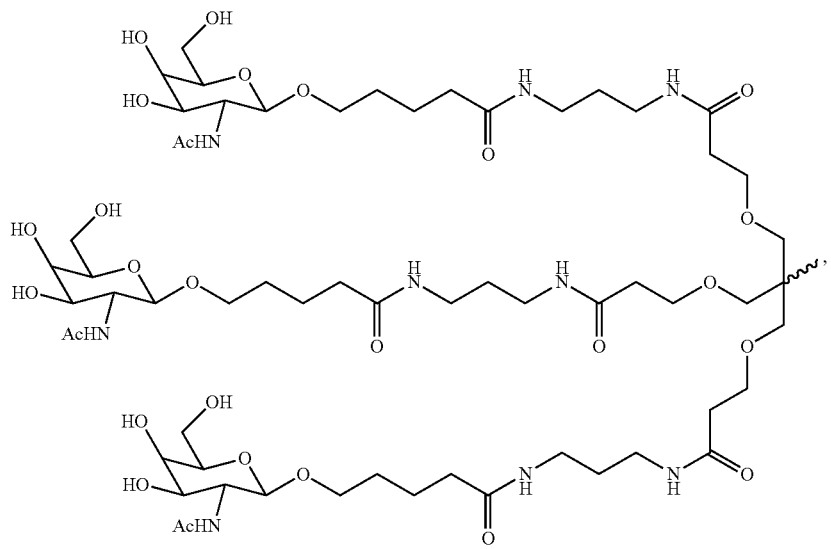
Formula III
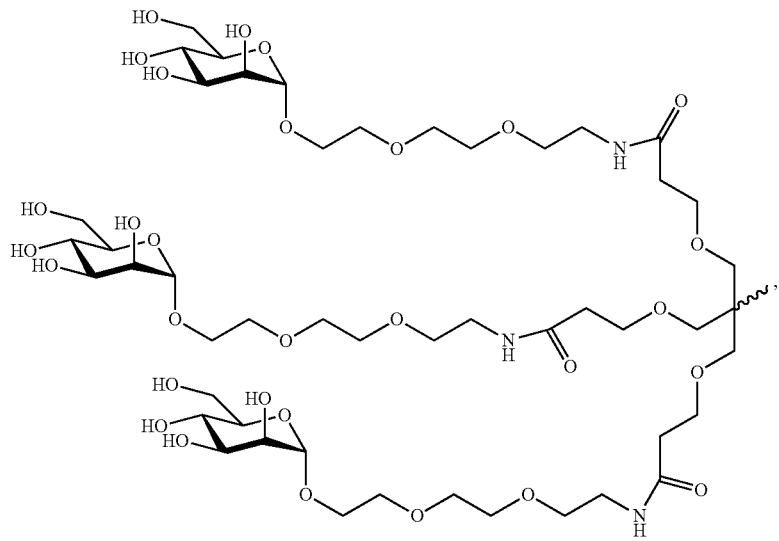
Formula IV
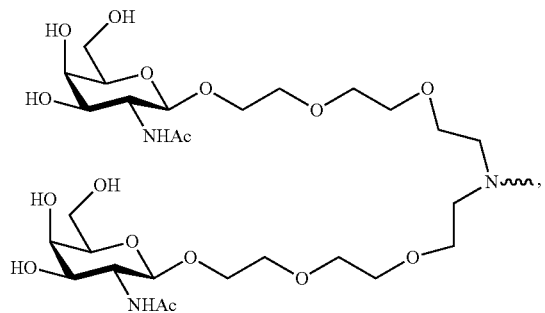
Formula V
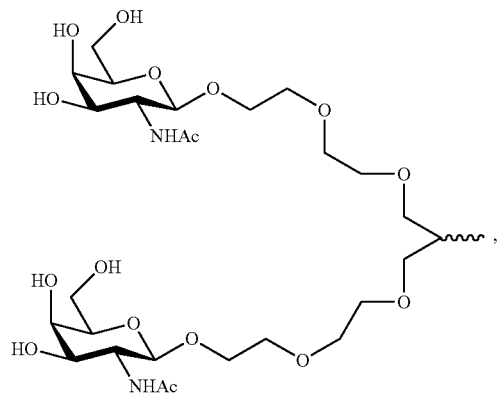

Formula VI
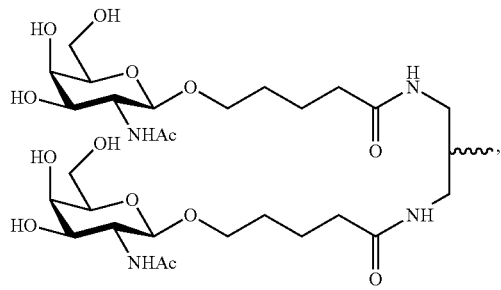
Formula VII
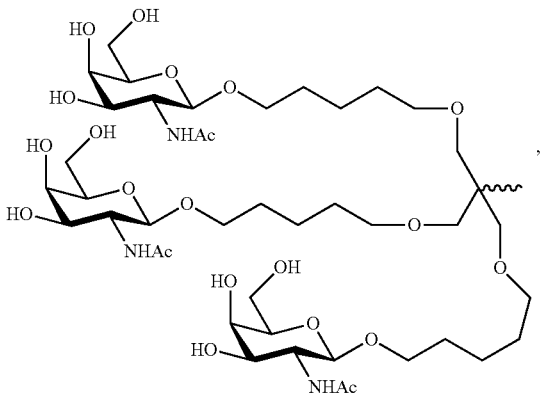
Formula VIII
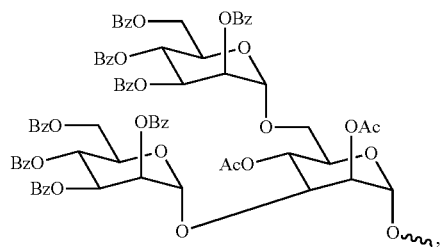
Formula IX
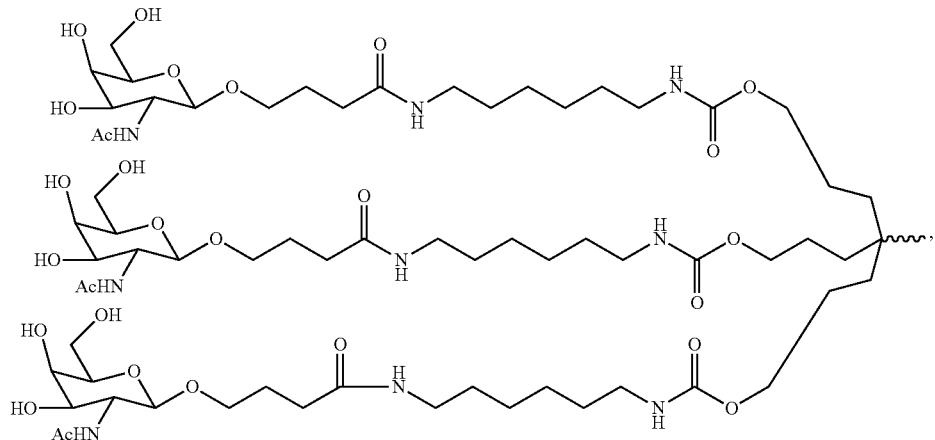
Formula X
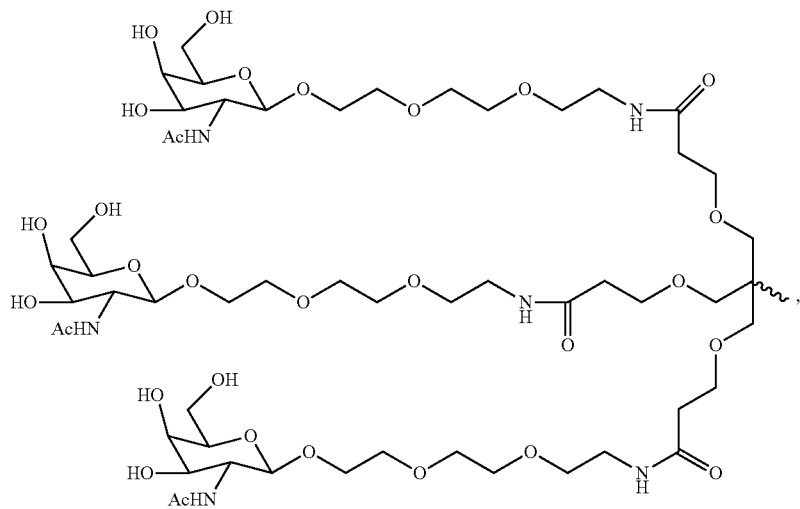

-continued
Formula XI
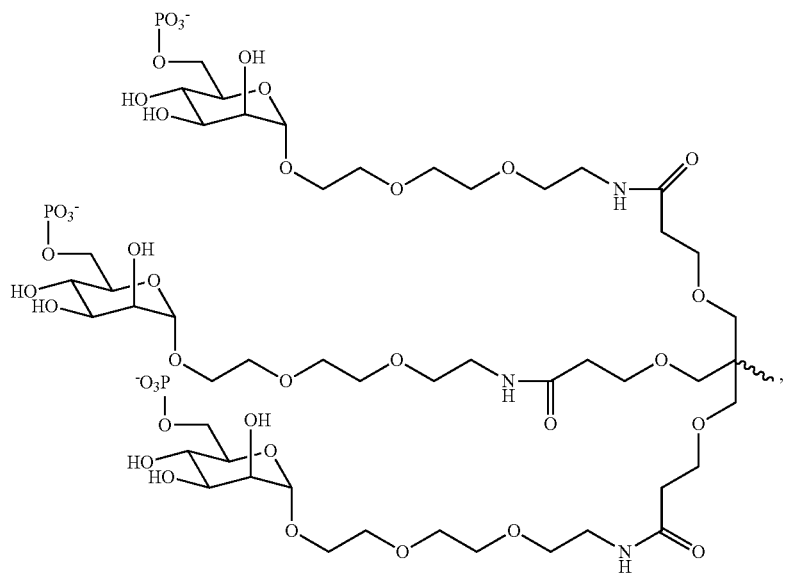
Formula XII
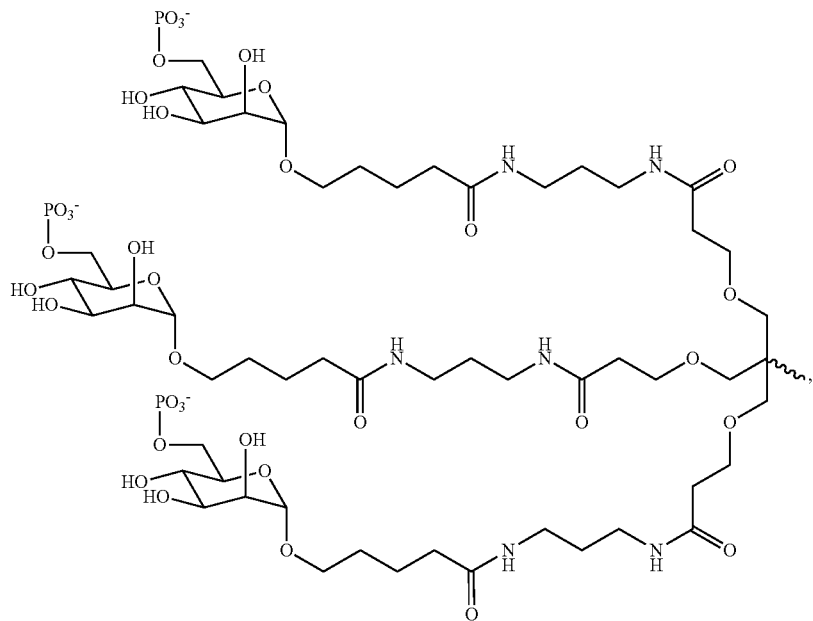
Formula XIII
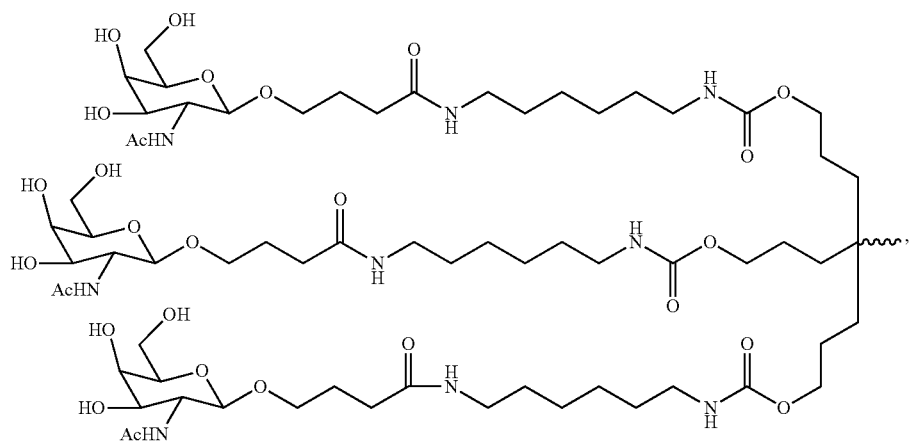

-continued
Formula XIV
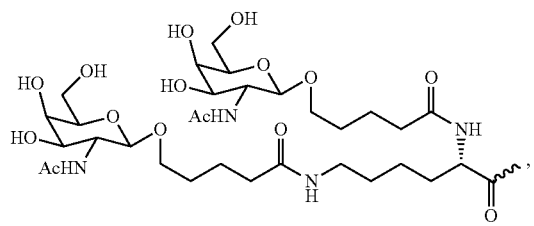
Formula XV
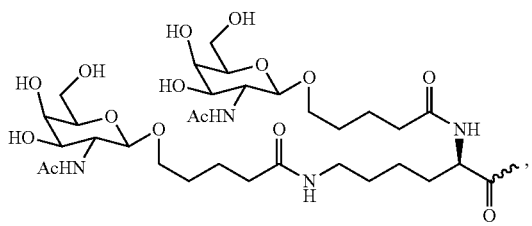
Formula XVI
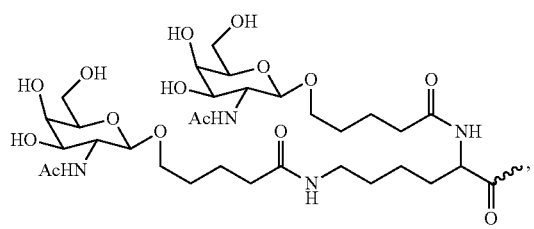
Formula XVII
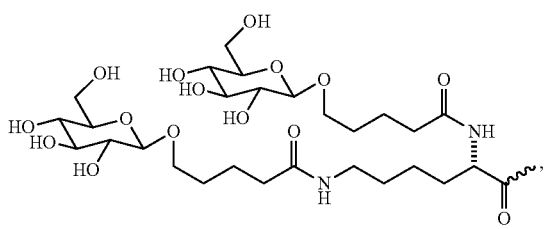
Formula XVIII
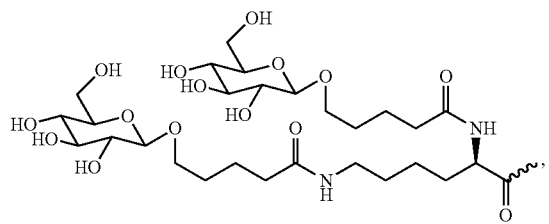
Formula XIX
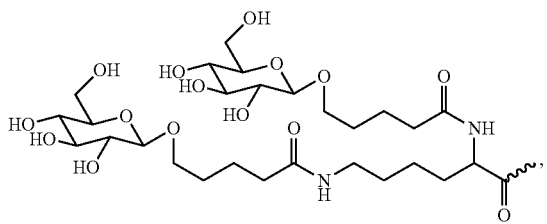
Formula XX
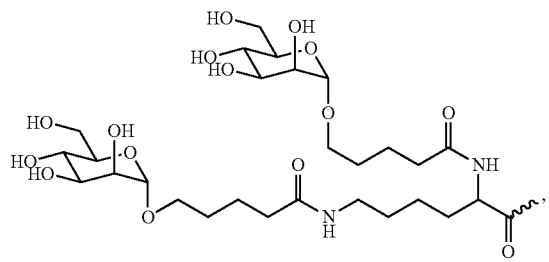
Formula XXI
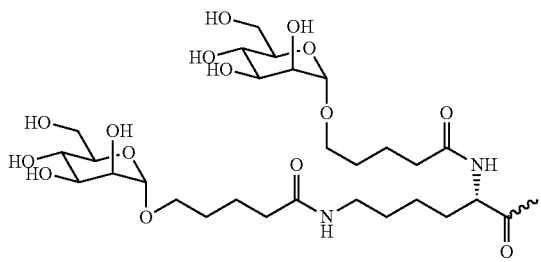
Formula XXII
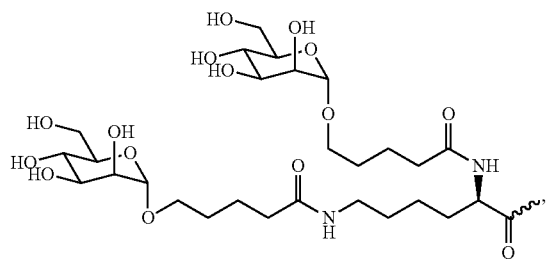
Formula XXIII
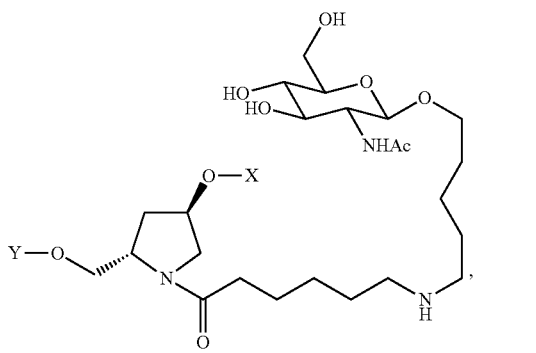

(Formula XXIV)
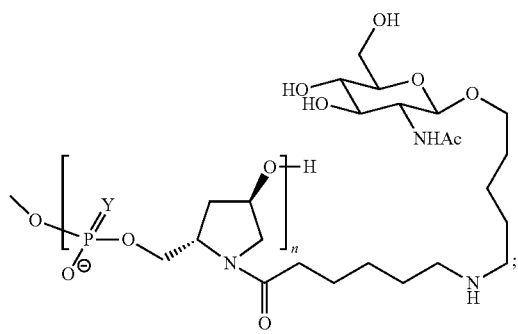
wherein Y is O or S and n is 3 - 6
(Formula XXV)
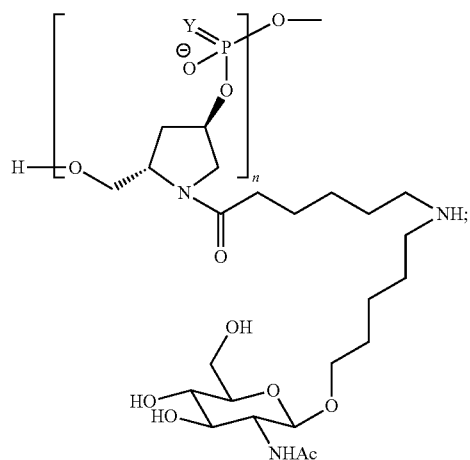
where in Y is O or S and n is 3 - 6
Formula XXVI
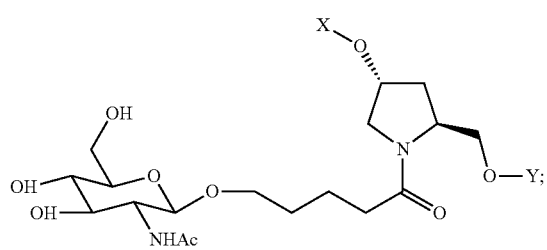
(Formula XXVII)
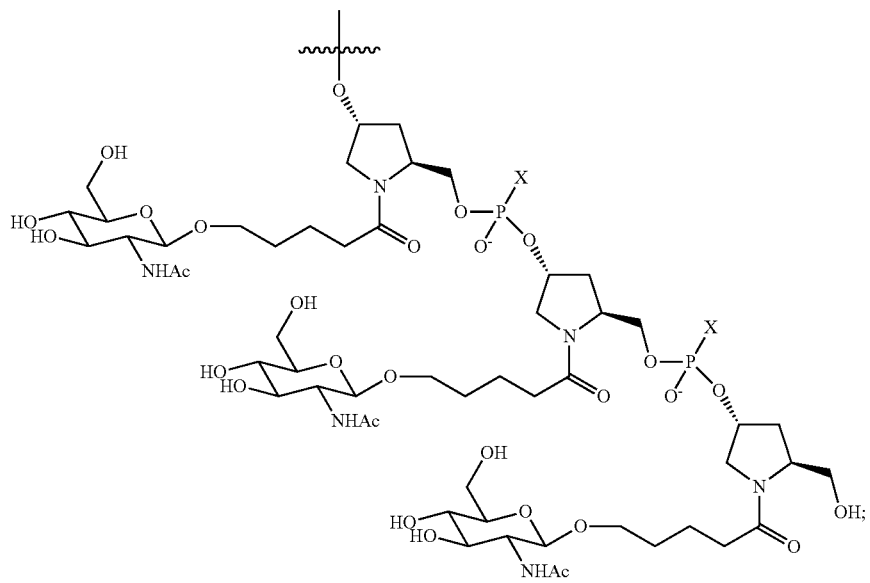
wherein X is O or S

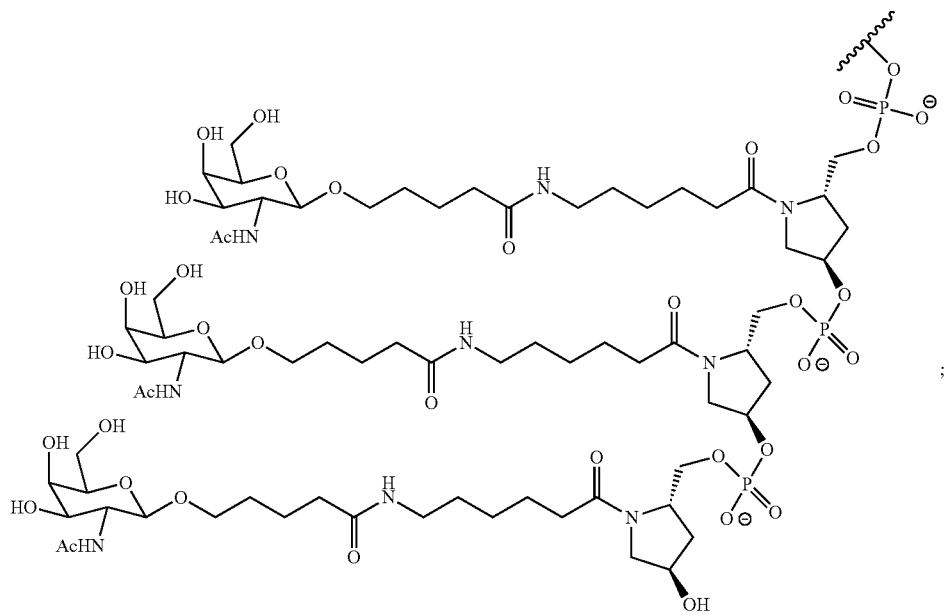
Formula XXVII
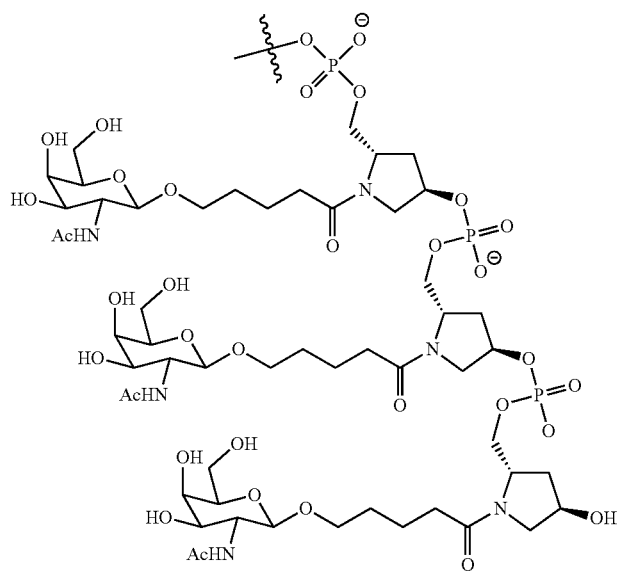
Formula XXIX
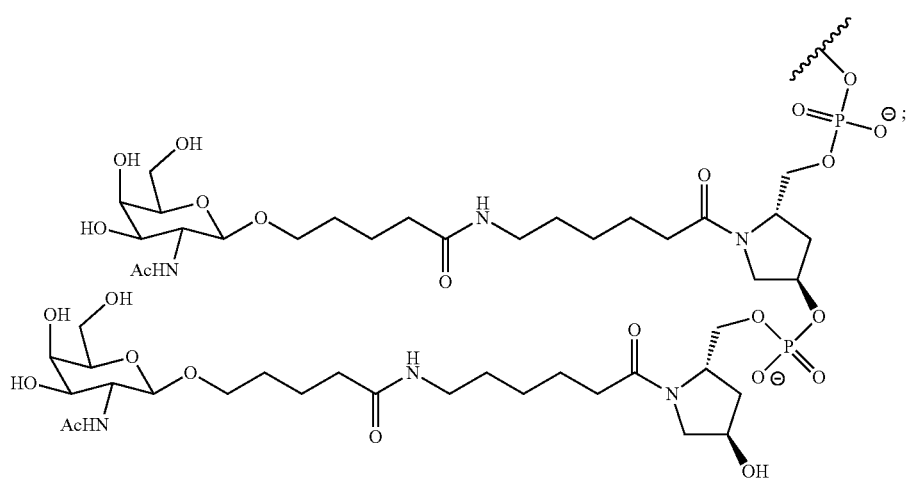
Formula XXXI

-continued
Formula XXX
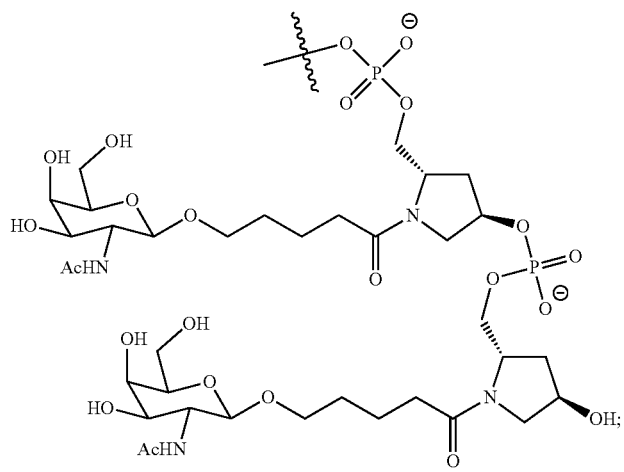
Formula XXXIII
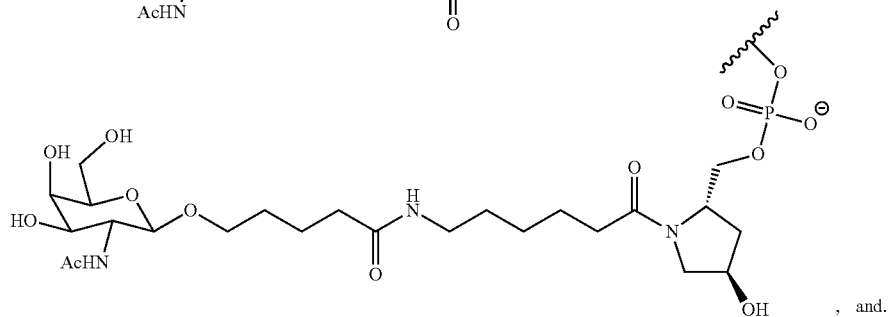
, and.
Formula XXXII
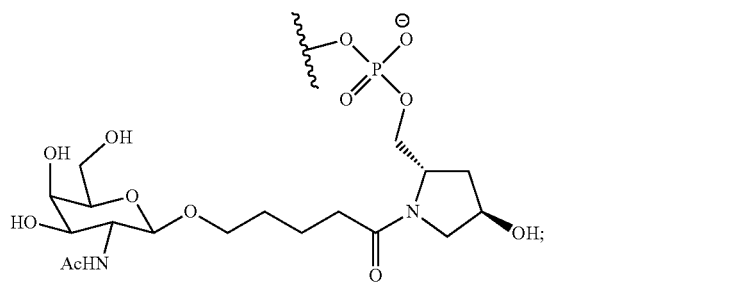
Formula XXXIV
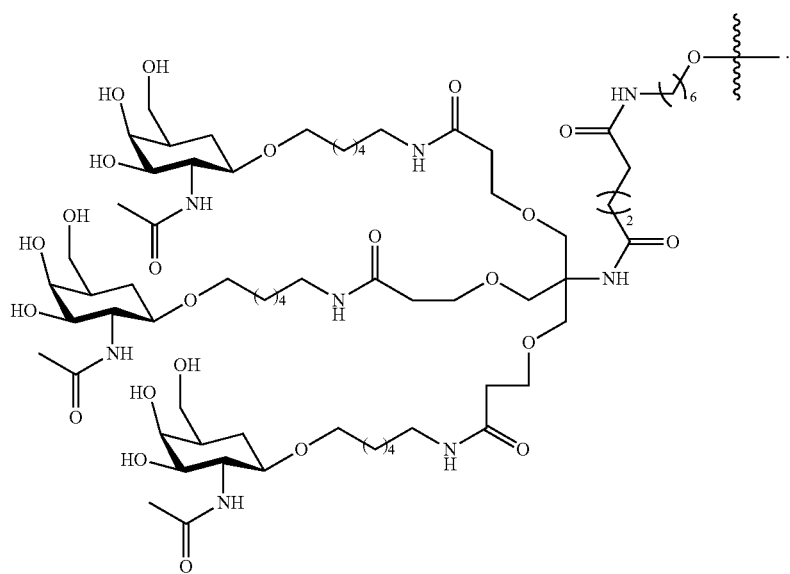

In another embodiment, a carbohydrate conjugate for use in the compositions and methods of the invention is a monosaccharide. In one embodiment, the monosaccharide is an N-acetylgalactosamine, such as
Formula II
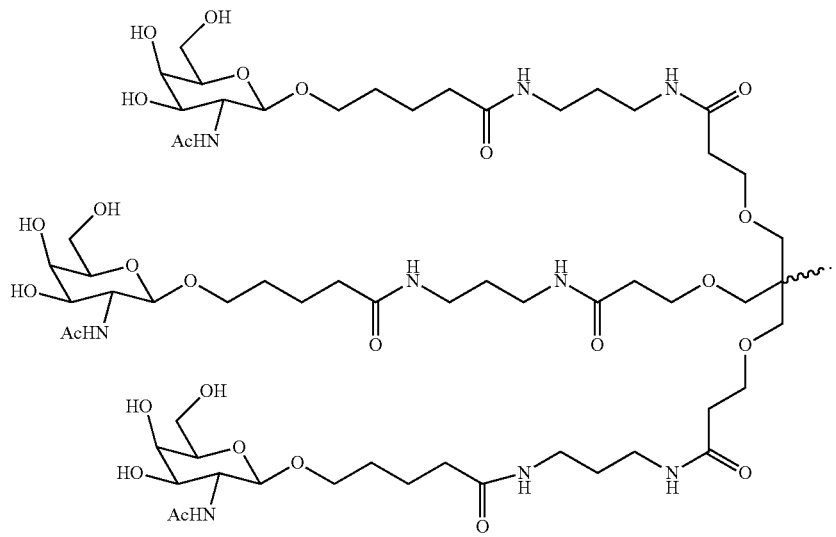
In some embodiments, the RNAi agent is attached to the carbohydrate conjugate via a linker as shown in the following schematic, wherein X is O or S
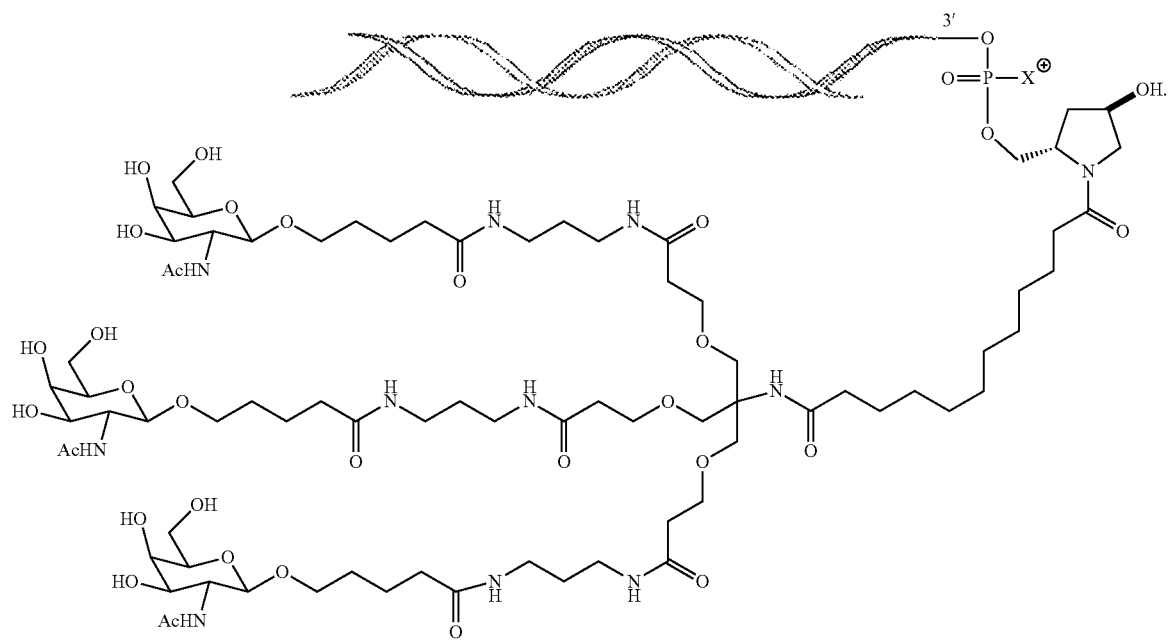

In some embodiments, the RNAi agent is conjugated to L96 as defined in Table 1 and shown below:

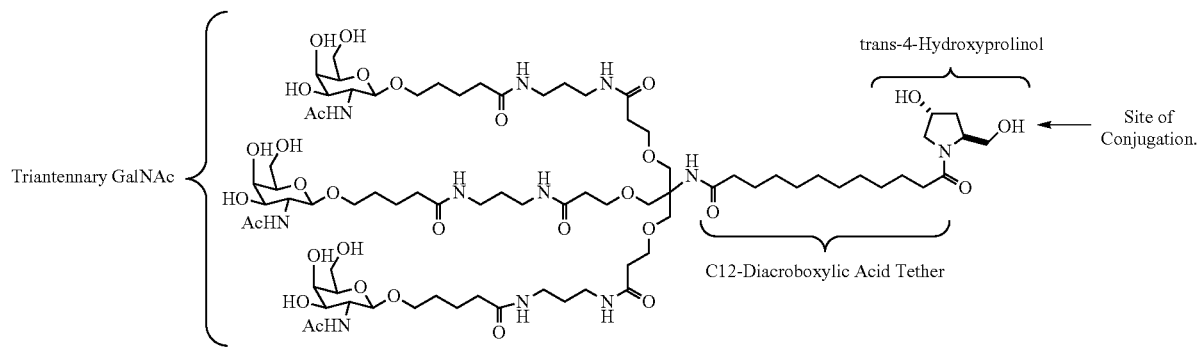

Another representative carbohydrate conjugate for use in the embodiments described herein includes, but is not limited to,

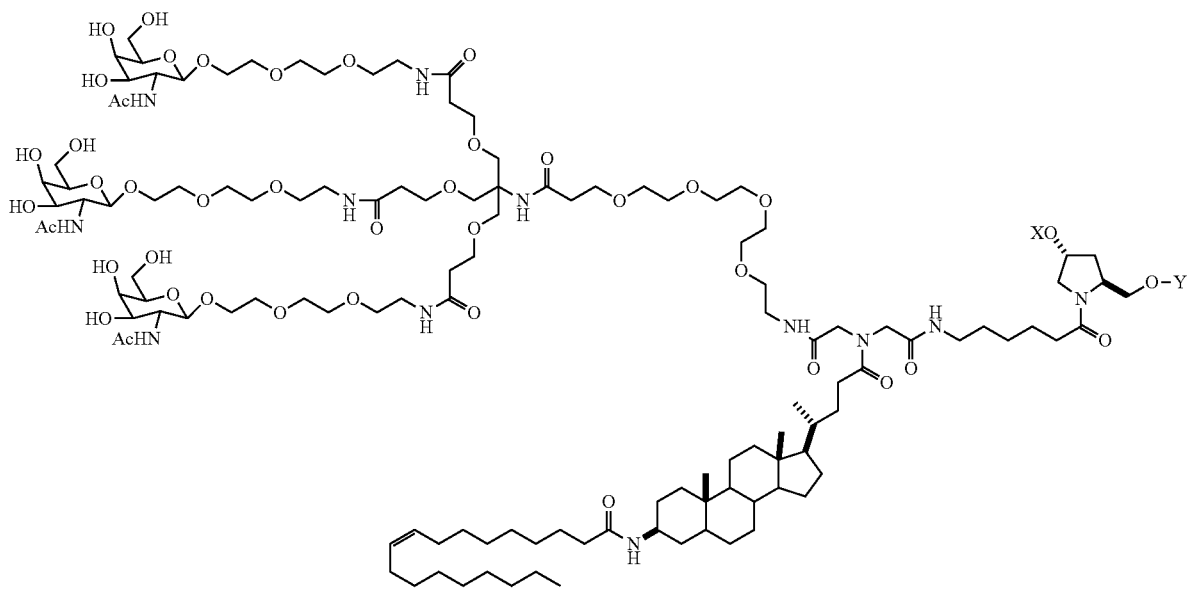

(Formula XXXVI), when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

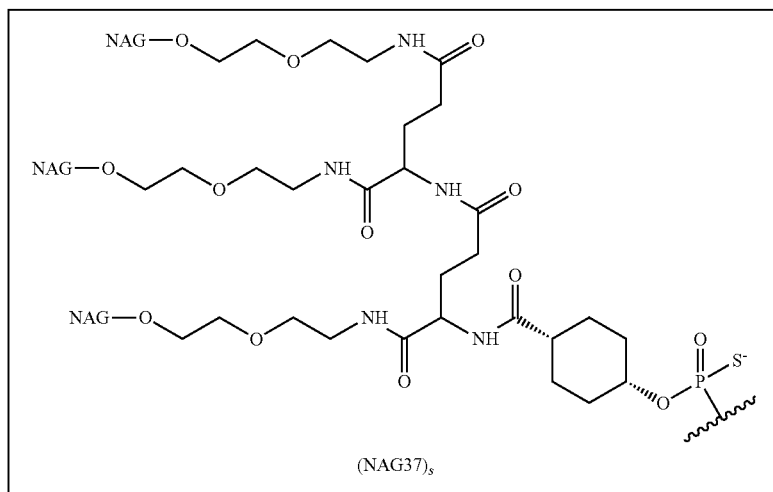

(NAG37)$_s$

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antisense strand. The GalNac may be attached to the 5'-end of the sense strand, the 3' end of the sense strand, the 5'-end of the antisense strand, or the 3'-end of the antisense strand. In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O. S. S(O), $SO_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In one embodiment, the cleavable linking group is cleaved at least about 10 times, 20, times, 30 times, 40 times, 50 times, 60 times, 70 times, 80 times, 90 times, or more, or at least 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a selected pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In certain embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—, wherein Rk at each occurrence can be, independently, C1-C20 alkyl, C1-C20 haloalkyl, C6-C10 aryl, or C7-C12 aralkyl. Exemplary embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. In certain embodiments a phosphate-based linking group is —O—P(O)(OH)—O—. These candidates can be evaluated using methods analogous to those described above.

iii. Acid Cleavable Linking Groups

In other embodiments, a cleavable linker comprises an acid cleavable linking group. An acid cleavable linking group is a linking group that is cleaved under acidic conditions. In certain embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to, (Formula XXXVII)

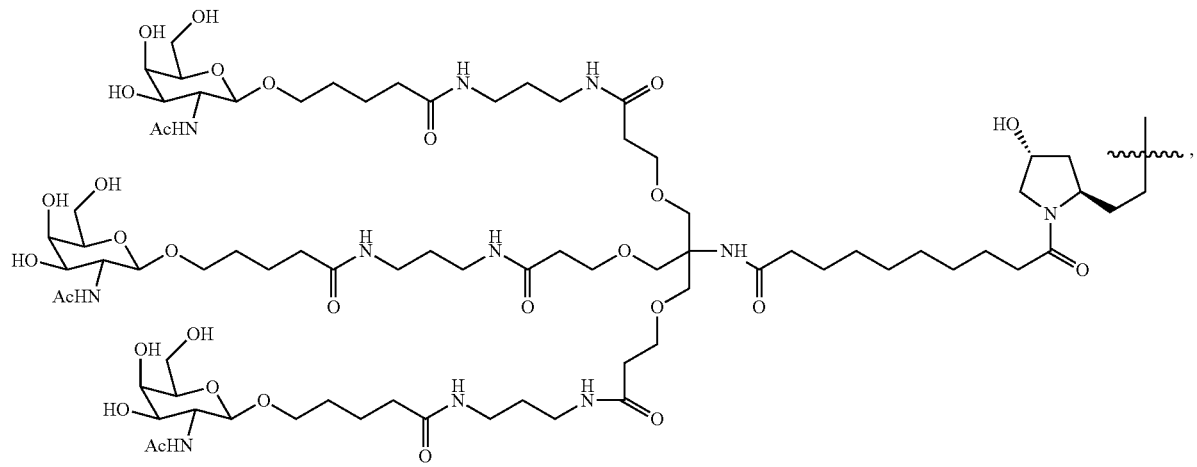

(Formula XXXVIII)

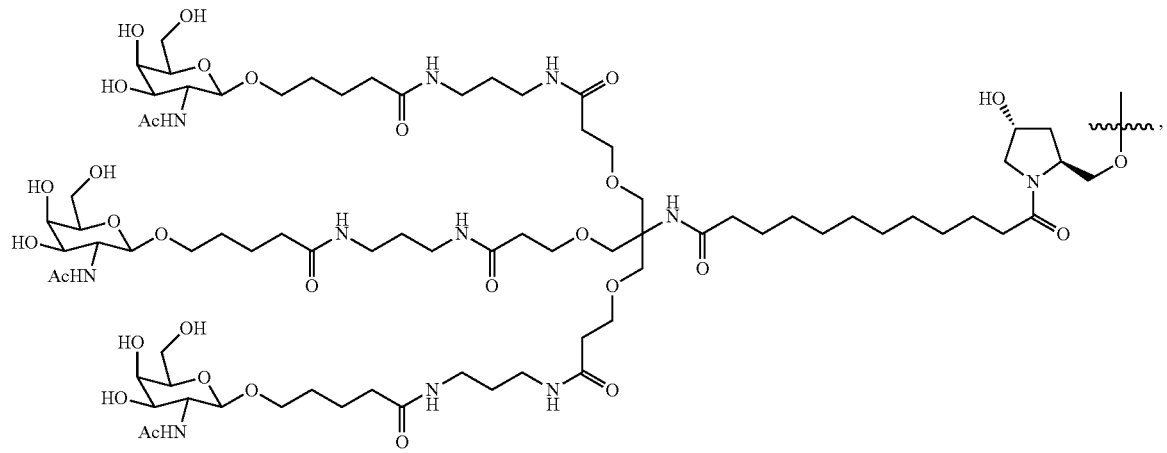

-continued
Formula (XXXIX)
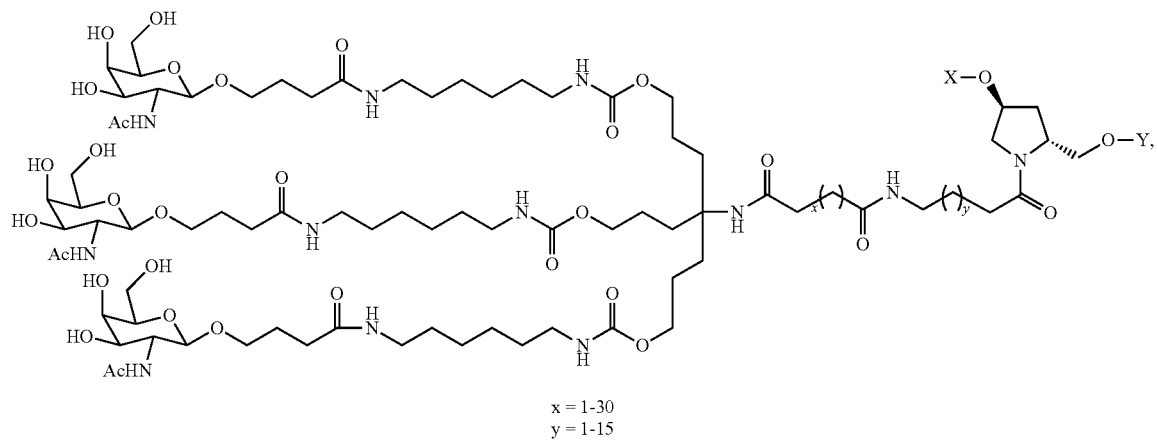
x = 1-30
y = 1-15
(Formula XL)
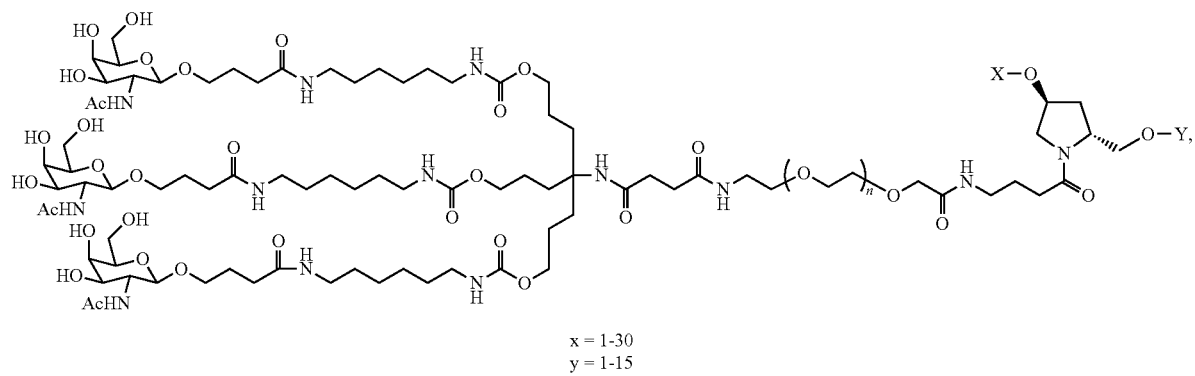
x = 1-30
y = 1-15
(Formula XLI)
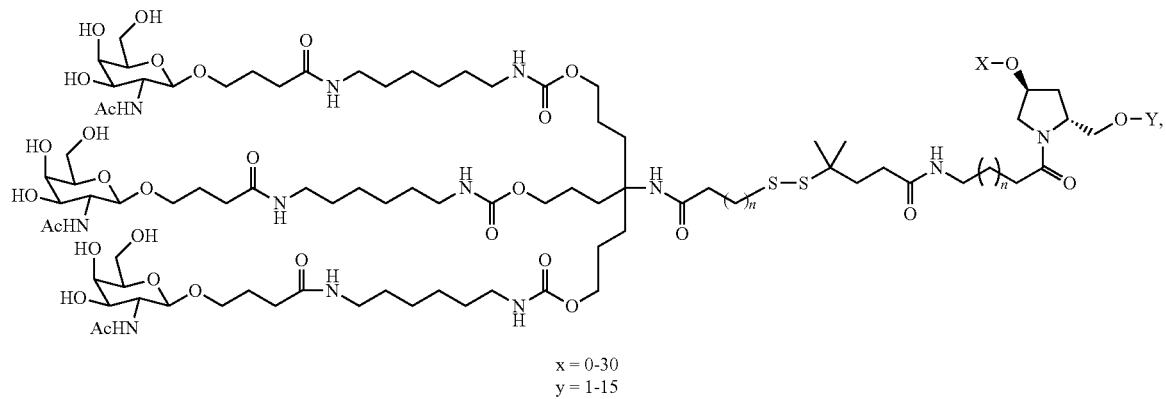
x = 0-30
y = 1-15

(Formula XXXII)

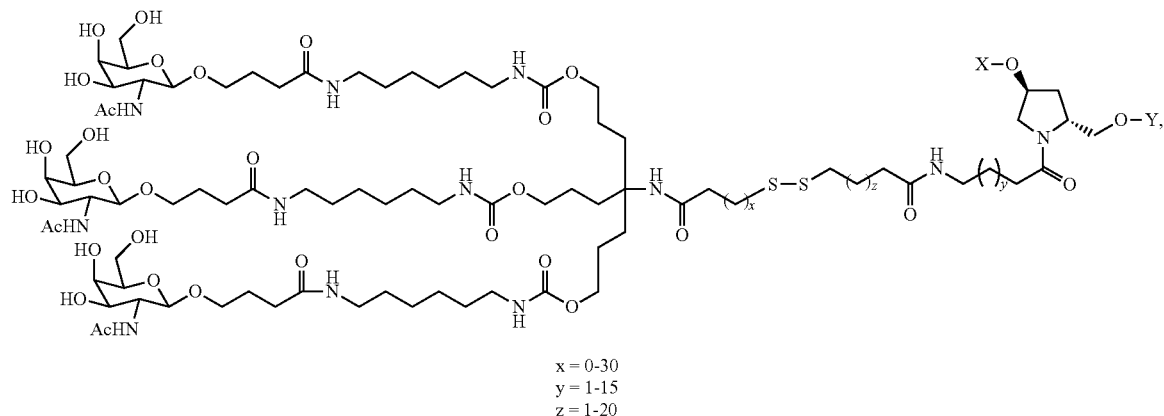

x = 0-30
y = 1-15
z = 1-20

(Formula XLIII)

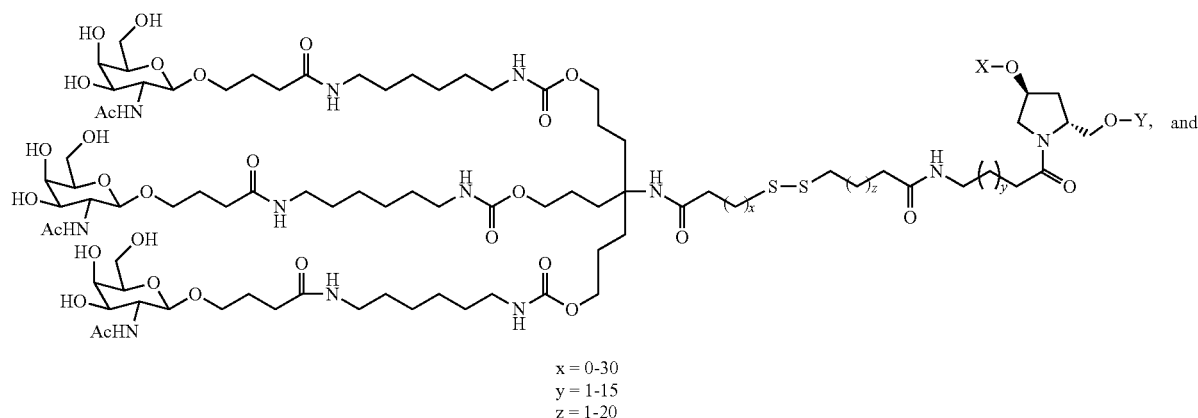

x = 0-30
y = 1-15
z = 1-20

(Formula XLIV)

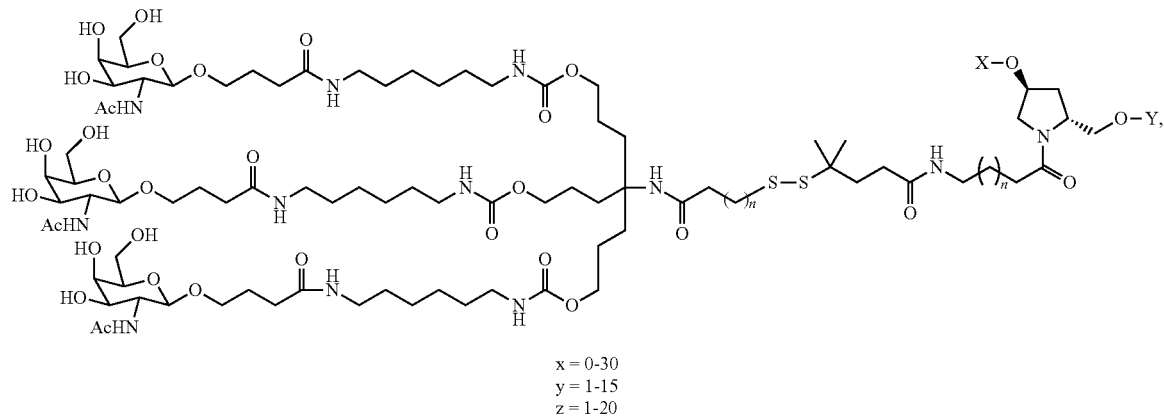

x = 0-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XLV)-(XLVI):

Formula XXXXV

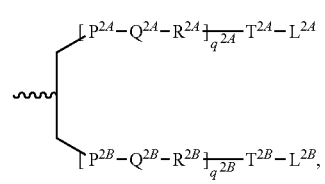

-continued

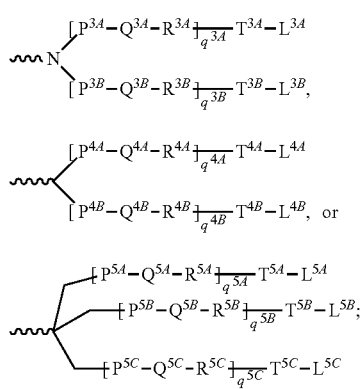

Formula XLVI

Formula XLVII

Formula XLVIII wherein:
q2A, q2B, q3A, q3B, q4A, q4B, q5A, q5B and q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;
$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, N(RN), C(R')=C(R''), C≡C or C(O);
$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, NHCH($R^a$)C(O), —C(O)—CH($R^a$)—NH—, CO, CH=N—O,

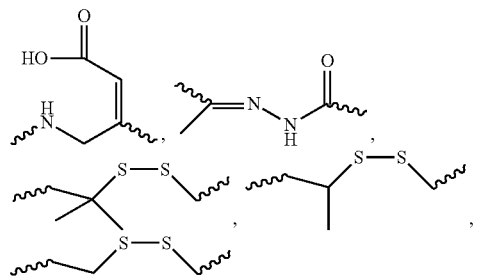

or heterocyclyl;
$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

Formula XLIX wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, such as dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of RNAs bearing an amino linker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject susceptible to or diagnosed with a coagulation Factor V-associated disorder) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S, and Julian R L. (1992) *Trends Cell. Biol.* 2(5): 139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602). Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178).

In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2): 107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) *J. Mol. Biol* 327:761-766; Verma, U N, et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Int J. Oncol.* 26:1087-1091), polyethyleneimine (Bonnet M E, et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting the coagulation Factor V gene can be expressed from transcription units inserted into DNA or RNA vectors (see, e.g., Couture, A, et al., *TIG.* (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for preventing or treating a coagulation Factor V-associated disorder. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of a coagulation Factor V gene.

In some embodiments, the pharmaceutical compositions of the invention are sterile. In another embodiment, the pharmaceutical compositions of the invention are pyrogen free.

The pharmaceutical compositions of the invention may be administered in dosages sufficient to inhibit expression of a coagulation Factor V gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, about 0.3 mg/kg to about 3.0 mg/kg. A repeat-dose regimen may include administration of a therapeutic amount of iRNA on a regular basis, such as every month, once every 3-6 months, or once a year. In certain embodiments, the iRNA is administered about once per month to about once per six months.

After an initial treatment regimen, the treatments can be administered on a less frequent basis. Duration of treatment can be determined based on the severity of disease.

In other embodiments, a single dose of the pharmaceutical compositions can be long lasting, such that doses are administered at not more than 1, 2, 3, or 4 month intervals. In some embodiments of the invention, a single dose of the pharmaceutical compositions of the invention is administered about once per month. In other embodiments of the invention, a single dose of the pharmaceutical compositions of the invention is administered quarterly (i.e., about every three months). In other embodiments of the invention, a single dose of the pharmaceutical compositions of the invention is administered twice per year (i.e., about once every six months).

The skilled artisan will appreciate that certain factors can influence the dosage and timing required to effectively treat a subject, including but not limited to mutations present in the subject, previous treatments, the general health or age of the subject, and other diseases present. Moreover, treatment of a subject with a prophylactically or therapeutically effective amount, as appropriate, of a composition can include a single treatment or a series of treatments.

The iRNA can be delivered in a manner to target a particular tissue (e.g., hepatocytes).

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers.

A. Additional Formulations
i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N. Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N. Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

The application of emulsion formulations via dermatological, oral, and parenteral routes, and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

ii. Microemulsions

In one embodiment of the present invention, the compositions of iRNAs and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989. VCH Publishers, New York, pages 185-215).

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers and their use in manufacture of pharmaceutical compositions and delivery of pharmaceutical agents are well known in the art.

v. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Such agent are well known in the art.

vi. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, or aromatic substances, and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating a coagulation Factor V-associated disorder.

Toxicity and prophylactic efficacy of such compounds can be determined by standard pharmaceutical procedures in cell cultures or experimental animals, e.g., for determining the LD50 (the dose lethal to 50% of the population) and the ED50 (the dose prophylactically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50, such as an ED80 or ED90, with little or no toxicity. The dosage can vary within this range depending upon the dosage form employed and the route of administration utilized. For any compound used in the methods featured in the invention, the prophylactically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) or higher levels of inhibition as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents used for the prevention or treatment of a coagulation Factor V-associated disorder. In any event, the administering physician can adjust the amount and timing of iRNA administration on the basis of results observed using standard measures of efficacy known in the art or described herein.

VI. Methods for Inhibiting Coagulation Factor V Expression

The present invention also provides methods of inhibiting expression of an F5 gene in a cell. The methods include contacting a cell with an RNAi agent, e.g., double stranded RNA agent, in an amount effective to inhibit expression of F5 in the cell, thereby inhibiting expression of F5 in the cell.

Contacting of a cell with an iRNA, e.g., a double stranded RNA agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In certain embodiments, the targeting ligand is a carbohydrate moiety, e.g., a GalNAc ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of a coagulation Factor V gene" is intended to refer to inhibition of expression of any coagulation Factor V gene (such as, e.g., a mouse coagulation Factor V gene, a rat coagulation Factor V gene, a monkey coagulation Factor V gene, or a human coagulation Factor V gene) as well as variants or mutants of a coagulation Factor V gene. Thus, the coagulation Factor V gene may be a wild-type coagulation Factor V gene, a mutant coagulation Factor V gene, or a transgenic coagulation Factor V gene in the context of a genetically manipulated cell, group of cells, or organism.

"Inhibiting expression of a coagulation Factor V gene" includes any level of inhibition of a coagulation Factor V gene, e.g., at least partial suppression of the expression of a coagulation Factor V gene, such as a clinically relevant level of suppression. The expression of the coagulation Factor V gene may be assessed based on the level, or the change in the level, of any variable associated with coagulation Factor V gene expression, e.g., coagulation Factor V mRNA level or coagulation Factor V protein level. Inhibition may be assessed by a decrease in an absolute or relative level of one or more of these variables compared with a control level. This level may be assessed in an individual cell or in a group of cells, including, for example, a sample derived from a subject. It is understood that coagulation Factor V is expressed predominantly in the liver, and is present in circulation.

Inhibition may be assessed by a decrease in an absolute or relative level of one or more variables that are associated with coagulation Factor V expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a coagulation Factor V gene is inhibited by at least 50%, 55%, 60%, 65%, 70%, 75%, 80%, 85%, 90%, or 95%, or to below the level of detection of the assay. In certain embodiments, expression of a coagulation Factor V gene is inhibited by at least 70%. It is further understood that inhibition of coagulation Factor V expression in certain tissues, e.g., in gall bladder, without a significant inhibition of expression in other tissues, e.g., brain, may be desirable. In certain embodiments, expression level is determined using the assay method provided in Example 2 with a 10 nM siRNA concentration in the appropriate species matched cell line.

In certain embodiments, inhibition of expression in vivo is determined by knockdown of the human gene in a rodent expressing the human gene, e.g., an AAV-infected mouse expressing the human target gene (i.e., coagulation Factor V), e.g., when administered as a single dose, e.g., at 3 mg/kg at the nadir of RNA expression. Knockdown of expression of an endogenous gene in a model animal system can also be determined, e.g., after administration of a single dose at, e.g., 3 mg/kg at the nadir of RNA expression. Such systems are useful when the nucleic acid sequence of the human gene and the model animal gene are sufficiently close such that the human iRNA provides effective knockdown of the model animal gene. RNA expression in liver is determined using the PCR methods provided in Example 2.

Inhibition of the expression of a coagulation Factor V gene may be manifested by a reduction of the amount of mRNA expressed by a first cell or group of cells (such cells may be present, for example, in a sample derived from a subject) in which a coagulation Factor V gene is transcribed and which has or have been treated (e.g., by contacting the cell or cells with an iRNA of the invention, or by administering an iRNA of the invention to a subject in which the cells are or were present) such that the expression of a coagulation Factor V gene is inhibited, as compared to a second cell or group of cells substantially identical to the first cell or group of cells but which has not or have not been so treated (control cell(s) not treated with an iRNA or not treated with an iRNA targeted to the gene of interest). In certain embodiments, the inhibition is assessed by the method provided in Example 2 using, e.g., a 10 nM siRNA concentration in the species matched cell line and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of a coagulation Factor V gene may be assessed in terms of a reduction of a parameter that is functionally linked to coagulation Factor V gene expression, e.g., coagulation Factor V protein level in blood or serum from a subject. Coagulation Factor V gene silencing may be determined in any cell expressing coagulation Factor V, either endogenous or heterologous from an expression construct, and by any assay known in the art.

Inhibition of the expression of a coagulation Factor V protein may be manifested by a reduction in the level of the coagulation Factor V protein that is expressed by a cell or group of cells or in a subject sample (e.g., the level of protein in a blood sample derived from a subject). As explained above, for the assessment of mRNA suppression, the inhibition of protein expression levels in a treated cell or group of cells may similarly be expressed as a percentage of the level of protein in a control cell or group of cells, or the change in the level of protein in a subject sample, e.g., blood or serum derived therefrom.

A control cell, a group of cells, or subject sample that may be used to assess the inhibition of the expression of a coagulation Factor V gene includes a cell, group of cells, or subject sample that has not yet been contacted with an RNAi agent of the invention. For example, the control cell, group of cells, or subject sample may be derived from an individual subject (e.g., a human or animal subject) prior to treatment of the subject with an RNAi agent or an appropriately matched population control.

The level of coagulation Factor V mRNA that is expressed by a cell or group of cells may be determined using any method known in the art for assessing mRNA expression. In one embodiment, the level of expression of coagulation Factor V in a sample is determined by detecting a transcribed polynucleotide, or portion thereof, e.g., mRNA of the coagulation Factor V gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene™ (PreAnalytix™, Switzerland). Typical assay formats utilizing ribonucleic acid hybridization include nuclear run-on assays, RT-PCR. RNase protection assays, northern blotting, in situ hybridization, and microarray analysis.

In some embodiments, the level of expression of coagulation Factor V is determined using a nucleic acid probe. The term "probe", as used herein, refers to any molecule that is capable of selectively binding to a specific coagulation Factor V. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to coagulation Factor V mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of coagulation Factor V mRNA.

An alternative method for determining the level of expression of coagulation Factor V in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of F5 is determined by quantitative fluorogenic RT-PCR (i.e., the TaqMan™ System). In some embodiments, expression level is determined by the method provided in Example 2 using, e.g., a 10 nM siRNA concentration, in the species matched cell line.

The expression levels of coagulation Factor V mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of coagulation Factor V expression level may also comprise using nucleic acid probes in solution.

In certain embodiments, the level of mRNA expression is assessed using branched DNA (bDNA) assays or real time PCR (qPCR). The use of these methods is described and exemplified in the Examples presented herein. In certain embodiments, expression level is determined by the method provided in Example 2 using a 10 nM siRNA concentration in the species matched cell line.

The level of F5 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention are assessed by a decrease in F5 mRNA or protein level (e.g., in a liver biopsy).

In some embodiments of the methods of the invention, the iRNA is administered to a subject such that the iRNA is delivered to a specific site within the subject. The inhibition of expression of coagulation Factor V may be assessed using measurements of the level or change in the level of coagulation Factor V mRNA or coagulation Factor V protein in a sample derived from fluid or tissue from the specific site within the subject (e.g., liver or blood).

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Prophylactic and Treatment Methods of the Invention

The present invention also provides methods of using an iRNA of the invention or a composition containing an iRNA of the invention to inhibit expression of coagulation Factor V, thereby preventing or treating a coagulation Factor V-associated disorder, e.g., a disorder associated with thrombosis.

In the methods of the invention the cell may be contacted with the siRNA in vitro or in vivo, i.e., the cell may be within a subject.

A cell suitable for treatment using the methods of the invention may be any cell that expresses a coagulation Factor V gene, e.g., a liver cell, a brain cell, a gall bladder cell, a heart cell, or a kidney cell. In one embodiment, the cell is a liver cell. A cell suitable for use in the methods of the invention may be a mammalian cell, e.g., a primate cell (such as a human cell, including human cell in a chimeric non-human animal, or a non-human primate cell, e.g., a monkey cell or a chimpanzee cell), or a non-primate cell. In certain embodiments, the cell is a human cell, e.g., a human liver cell. In the methods of the invention, coagulation Factor V expression is inhibited in the cell by at least 50, 55, 60, 65, 70, 75, 80, 85, 90, or 95, or to a level below the level of detection of the assay.

The in vivo methods of the invention may include administering to a subject a composition containing an iRNA, where the iRNA includes a nucleotide sequence that is complementary to at least a part of an RNA transcript of the coagulation Factor V gene of the mammal to which the RNAi agent is to be administered. The composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intramuscular injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of F5, or a therapeutic or prophylactic effect. A depot injection may also provide more consistent serum concentrations. Depot injections may include subcutaneous injections or intramuscular injections. In certain embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In certain embodiments, the infusion pump is a subcutaneous infusion pump. In other embodiments, the pump is a surgically implanted pump that delivers the iRNA to the liver.

The mode of administration may be chosen based upon whether local or systemic treatment is desired and based upon the area to be treated. The route and site of administration may be chosen to enhance targeting.

In one aspect, the present invention also provides methods for inhibiting the expression of a coagulation Factor V gene in a mammal. The methods include administering to the mammal a composition comprising a dsRNA that targets a coagulation Factor V gene in a cell of the mammal and maintaining the mammal for a time sufficient to obtain degradation of the mRNA transcript of the coagulation Factor V gene, thereby inhibiting expression of the coagulation Factor V gene in the cell. Reduction in gene expression can be assessed by any methods known in the art and by methods, e.g. qRT-PCR, described herein, e.g., in Example 2. Reduction in protein production can be assessed by any methods known it the art, e.g. ELISA. In certain embodiments, a puncture liver biopsy sample serves as the tissue material for monitoring the reduction in the coagulation Factor V gene or protein expression. In other embodiments, a blood sample serves as the subject sample for monitoring the reduction in the coagulation Factor V protein expression.

The present invention further provides methods of treatment in a subject in need thereof, e.g., a subject diagnosed with a coagulation Factor V-associated disorder, such as, a disorder associated with thrombosis.

The present invention further provides methods of prophylaxis in a subject in need thereof. The treatment methods of the invention include administering an iRNA of the invention to a subject, e.g., a subject that would benefit from a reduction of coagulation Factor V expression, in a prophylactically effective amount of an iRNA targeting a coagulation Factor V gene or a pharmaceutical composition comprising an iRNA targeting a coagulation Factor V gene.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from an inhibition of coagulation Factor V expression are subjects susceptible to or diagnosed with an F5-associated disorder, e.g., subjects susceptible to or diagnosed with, e.g., a disorder associated with thrombosis. Non-limiting examples of disorders or diseases associated with thrombosis include venous thrombosis, e.g., deep vein thrombosis; genetic thrombophilia, e.g., Factor V leiden and prothrombin thrombophilia; plurpura fulminans; acquired thrombophilia, e.g., antiphospholipid syndrome and systemic lupus erythematosus; drug induced thrombophilia; arterial thrombosis, e.g., myocardial infarction and peripheral arterial disease; thromboembolic disease, e.g., pulmonary embolus embolic and ischemic stroke; atrial fibrillation; post-surgery deep vein thrombosis; cancer thrombosis or infectious disease thrombosis.

In an embodiment, the method includes administering a composition featured herein such that expression of the target coagulation Factor V gene is decreased, such as for about 1, 2, 3, 4, 5, 6, 1-6, 1-3, or 3-6 months per dose. In certain embodiments, the composition is administered once every 3-6 months.

In some embodiments, the iRNAs useful for the methods and compositions featured herein specifically target RNAs (primary or processed) of the target coagulation Factor V gene. Compositions and methods for inhibiting the expression of these genes using iRNAs can be prepared and performed as described herein.

Administration of the iRNA according to the methods of the invention may result prevention or treatment of a coagulation Factor V-associated disorder, e.g., a disorder associated with thrombosis. Non-limiting examples of disorders or diseases associated with thrombosis include venous thrombosis, e.g., deep vein thrombosis; genetic thrombophilia, e.g., Factor V leiden and prothrombin thrombophilia; plurpura fulminans; acquired thrombophilia, e.g., antiphospholipid syndrome and systemic lupus erythematosus; drug induced thrombophilia; arterial thrombosis, e.g., myocardial infarction and peripheral arterial disease; thromboembolic disease, e.g., pulmonary embolus embolic and ischemic stroke; atrial fibrillation; post-surgery deep vein thrombosis; cancer thrombosis or infectious disease thrombosis.

Subjects can be administered a therapeutic amount of iRNA, such as about 0.01 mg/kg to about 200 mg/kg. Subjects can be administered a therapeutic amount of iRNA, such as about 5 mg to about 1000 mg as a fixed dose, regardless of body weight.

In some embodiments, the iRNA is administered subcutaneously, i.e., by subcutaneous injection. One or more injections may be used to deliver the desired dose of iRNA to a subject. The injections may be repeated over a period of time.

The administration may be repeated on a regular basis. In certain embodiments, after an initial treatment regimen, the treatments can be administered on a less frequent basis. A repeat-dose regimen may include administration of a therapeutic amount of iRNA on a regular basis, such as once per month to once a year. In certain embodiments, the iRNA is administered about once per month to about once every three months, or about once every three months to about once every six months.

The invention further provides methods and uses of an iRNA agent or a pharmaceutical composition thereof for treating a subject that would benefit from reduction or inhibition of F5 gene expression, e.g., a subject having an F5-associated disease, in combination with other pharmaceuticals or other therapeutic methods, e.g., with known pharmaceuticals or known therapeutic methods, such as, for example, those which are currently employed for treating these disorders.

In certain embodiments, the additional therapeutic agent is an anticoagulant. In some embodiments, the anticoagulant includes heparin, enoxaparin (Lovenox), dalteparin (Fragmin), fondaparinux (Arixtra), warfarin (Coumadin, Jantoven), dabigatran (Pradaxa), rivaroxaban (Xarelto), apixaban (Eliquis), edoxaban (Savaysa), argatroban or any combination thereof. In some embodiments, the additional therapeutic agent includes a thrombolytic. In certain embodiments, the thrombolytic includes antistreplase (Eminase), tissue plasminogen activator (tPA), urokinase-type plasminogen activator (uPA), or any combination thereof. In some embodiments, the additional therapeutic agent is an immunosuppressant. In certain embodiments, the immunosuppressant includes corticosteroid, azathioprine, cyclosporine A, or any combination thereof. In some embodiments, the additional therapeutic agent is hormone replacement therapy. In certain embodiments, the hormone replacement therapy includes estrogen, gestagen, androgen or any combination thereof. In some embodiments, the additional therapeutic agent is an antibiotic. In some embodiments, the additional therapeutic agent is an antihistamine agent. In some embodiments, the additional therapeutic agent is a mast cell stabilizer. In certain embodiments, the mast cell stabilizer includes cromoglicic acid (Cromolyn), lodoxamide (Alomide), or any combination thereof. In some embodiments, the additional therapeutic agent is an anti-proliferative agent. In some embodiments, the additional therapeutic agent is an oral contraceptive. In some embodiments, the additional therapeutic agent is a fresh frozen plasma or a plasminogen concentrate. In some embodiments, the additional therapeutic agent is hyaluronidase. In some embodiments, the additional therapeutic agent is alpha chymotrypsin. In certain embodiment, the additional therapeutic agent is a filter inserted into a large vein that prevents clots that break loose from lodging in the patient's lungs. In certain embodiments, the additional therapeutic agent is selected from the group consisting of an anticoagulant, an F5 inhibitor and a thrombin inhibitor.

Accordingly, in some aspects of the invention, the methods which include either a single iRNA agent of the invention, further include administering to the subject one or more additional therapeutic agents. The iRNA agent and an additional therapeutic agent or treatment may be administered at the same time or in the same combination, e.g., parenterally, or the additional therapeutic agent can be administered as part of a separate composition or at separate times or by another method known in the art or described herein.

In one embodiment, an iRNA agent is administered in combination with allopurinol. In one embodiment, the iRNA agent is administered to the patient, and then the additional therapeutic agent is administered to the patient (or vice versa). In another embodiment, the iRNA agent and the additional therapeutic agent are administered at the same time.

The iRNA agent and an additional therapeutic agent or treatment may be administered at the same time or in the same combination, e.g., parenterally, or the additional therapeutic agent can be administered as part of a separate composition or at separate times or by another method known in the art or described herein.

VIII. Kits

In certain aspects, the instant disclosure provides kits that include a suitable container containing a pharmaceutical formulation of a siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe), or means for measuring the inhibition of F5 (e.g., means for measuring the inhibition of F5 mRNA, F5 protein, or F5 activity). Such means for measuring the inhibition of F5 may comprise a means for obtaining a sample from a subject, such as, e.g., a plasma sample. The kits of the invention may optionally further comprise means for determining the therapeutically effective or prophylactically effective amount.

In certain embodiments the individual components of the pharmaceutical formulation may be provided in one container, e.g., a vial or a pre-filled syringe. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

This invention is further illustrated by the following examples which should not be construed as limiting. The entire contents of all references, patents and published patent applications cited throughout this application, as well as the informal Sequence Listing and Figures, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the Coagulation Factor V (F5) gene, (human: NCBI refseqID NM_000130.4; NCBI GeneID: 2153) were designed using custom R and Python scripts. The human NM_000130.4 REFSEQ mRNA, version 4, has a length of 9719 bases.

A detailed list of the unmodified F5 sense and antisense strand nucleotide sequences are shown in Table 2. A detailed list of the modified F5 sense and antisense strand nucleotide sequences are shown in Table 3.

It is to be understood that, throughout the application, a duplex name without a decimal is equivalent to a duplex name with a decimal which merely references the batch number of the duplex. For example, AD-959917 is equivalent to AD-959917.1.

siRNA Synthesis siRNAs were synthesized and annealed using routine methods known in the art.

Briefly, siRNA sequences were synthesized on a 1 µmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O-methyl, RNA, DNA) were obtained from Thermo-Fisher (Milwaukee, WI), Hongene (China), or Chemgenes (Wilmington, MA, USA). Additional phosphoramidite monomers were procured from commercial suppliers, prepared in-house, or procured using custom synthesis from various CMOs. Phosphoramidites were prepared at a concentration of 100 mM in either acetonitrile or 9:1 acetonitrile:DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 µL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA·3HF (triethylamine trihydrofluoride). To each oligonucleotide solution in aqueous methylamine was added 200 µL of dimethyl sulfoxide (DMSO) and 300 µL TEA·3HF and the solution was incubated for approximately 30 mins at 60° C. After incubation, the plate was allowed to come to room temperature and crude oligonucleotides were precipitated by the addition of 1 mL of 9:1 acetontrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 µM in 1×PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

Example 2. In Vitro Screening Methods

Cell Culture and 384-Well Transfections

Hep3b cells (ATCC, Manassas, VA) were grown to near confluence at 37° C. in an atmosphere of 5% $CO_2$ in Eagle's Minimum Essential Medium (Gibco) supplemented with 10% FBS (ATCC) before being released from the plate by trypsinization. Transfection of Hep3b cells was carried out by adding 14.8 µl of Opti-MEM plus 0.2 µl of Lipofectamine RNAiMax per well (Invitrogen, Carlsbad CA. cat #13778-150) to 5 µl of each siRNA duplex to an individual well in a 96-well plate. The mixture was then incubated at room temperature for 15 minutes. Eighty µl of complete growth media without antibiotic containing ~2×10$^4$ Hep3B cells was then added to the siRNA mixture. Cells were incubated for 24 hours prior to RNA purification. Single dose experiments are performed at 10 nM final duplex concentration.

Total RNA Isolation Using DYNABEADS mRNA Isolation Kit (Invitrogen™ Part #: 610-12)

Cells were lysed in 75 µl of Lysis/Binding Buffer containing 3 µL of beads per well and mixed for 10 minutes on an electrostatic shaker. The washing steps were automated on a Biotek EL406, using a magnetic plate support. Beads were washed (in 90 µL) once in Buffer A, once in Buffer B, and twice in Buffer E, with aspiration steps in between. Following a final aspiration, complete 10 µL RT mixture was added to each well, as described below.

cDNA Synthesis Using ABI High Capacity cDNA Reverse Transcription Kit (Applied Biosystems, Foster City, CA, Cat #4368813)

A master mix of 1 µl 10× Buffer, 0.4 µl 25×dNTPs, 1 µl Random primers, 0.5 µl Reverse Transcriptase, 0.5 µl RNase inhibitor and 6.6 µl of $H_2O$ per reaction was added per well. Plates were sealed, agitated for 10 minutes on an electrostatic shaker, and then incubated at 37 degrees C. for 2 hours. Following this, the plates were agitated at 80 degrees C. for 8 minutes.

Real Time PCR

Two microlitre (µl) of cDNA were added to a master mix containing 0.5 µl of human GAPDH TaqMan Probe (4326317E), 0.5 µl human F5 probe, 2 µl nuclease-free water and 5 µl Lightcycler 480 probe master mix (Roche Cat #04887301001) per well in a 384 well plates (Roche cat #04887301001). Real time PCR was done in a LightCycler480 Real Time PCR system (Roche).

To calculate relative fold change, data were analyzed using the ΔΔCt method and normalized to assays performed with cells transfected with 10 nM AD-1955, or mock transfected cells. $IC_{50}$s were calculated using a 4 parameter fit model using XLFit and normalized to cells transfected with AD-1955 or mock-transfected. The sense and antisense sequences of AD-1955 are: sense: cuuAcGcuGAGuAcuucGAdTsdT (SEQ ID NO: 29) and antisense (SEQ ID NO: 30)
UCGAAGuACUcAGCGuAAGdTsdT.

The results of the single dose screen of the agents in Tables 2 and 3 in Hep3b cells are shown in Table 4.

TABLE 1

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
|---|---|
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
|---|---|
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol (Hyp-(GalNAc-alkyl)3) |

| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythimidine-3'-phosphate |
| dTs | 2'-deoxythimidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Ahd) | 2'-O-hexadecyl-adenosine-3'-phosphate |
| (Ahd) | 2'-O-hexadecyl-adenosine-3'-phosphate |
| (Ahds) | 2'-O-hexadecyl-adenosine-3'-phosphorothioate |
| (Chd) | 2'-O-hexadecyl-cytidine-3'-phosphate |
| (Chds) | 2'-O-hexadecyl-cytidine-3'-phosphorothioate |
| (Ghd) | 2'-O-hexadecyl-guanosine-3'-phosphate |
| (Ghds) | 2'-O-hexadecyl-guanosine-3'-phosphorothioate |
| (Uhd) | 2'-O-hexadecyl-uridine-3'-phosphate |
| (Uhds) | 2'-O-hexadecyl-uridine-3'-phosphorothioate |

TABLE 2

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-109601 | AAAGUGGAUCAUAUCUUCUCU | 31 | 1057-1077 | AGAGAAGAUAUGAUCCACUUUCC | 162 | 1055-1077 |
| AD-109799 | UCAAACCAAAUUGGAAAACAU | 32 | 1295-1315 | AUGUUUUCCAAUUUGGUUUGAGA | 163 | 1293-1315 |
| AD-110052 | UAAGUGGAACAUCUUAGAGUU | 33 | 1594-1614 | AACUCUAAGAUGUUCCACUUAUA | 164 | 1592-1614 |
| AD-110281 | GAGGACAACAUCAACAAGUUU | 34 | 1823-1843 | AAACUUGUUGAUGUUGUCCUCAA | 165 | 1821-1843 |
| AD-110370 | GCAUAACUACUCUUGGAUUCU | 35 | 1932-1952 | AGAAUCCAAGAGUAGUUAUGCUC | 166 | 1930-1952 |
| AD-110518 | UUGGAACUUGGAUGUUAACUU | 36 | 2118-2138 | AAGUUAACAUCCAAGUUCCAACA | 167 | 2116-2138 |
| AD-110787 | GAAGAAGAGUUCAAUCUUACU | 37 | 2387-2407 | AGUAAGAUUGAACUCUUCUUCUU | 168 | 2385-2407 |
| AD-110844 | UCAAACAGAUAUAAUUGUU | 38 | 2444-2464 | AACAAUUAUAUCUGUGUUUGAAG | 169 | 2442-2464 |
| AD-111287 | AAGUAACUCAUCUAAGAUUUU | 39 | 2953-2973 | AAAAUCUUAGAUGAGUUACUUUG | 170 | 2951-2973 |
| AD-111345 | UAUGAAAUAAUCCAAGAUACU | 40 | 3011-3031 | AGUAUCUUGGAUUAUUUCAUAGC | 171 | 3009-3031 |
| AD-111483 | ACUGAAGAAAGCCAGUUUCU | 41 | 3202-3222 | AGAAACUGGCUUUUCUUCAGUCU | 172 | 3200-3222 |
| AD-112322 | UCAUUGCUUCUUCAAGAAUUU | 42 | 4559-4579 | AAAUUCUUGAAGAAGCAAUGACU | 173 | 4557-4579 |
| AD-112396 | UACUCUCAAUGAUACUUUUCU | 43 | 4633-4653 | AGAAAAGUAUCAUUGAGAGUAGG | 174 | 4631-4653 |
| AD-112618 | AAACAGAAGAAAUUAUUACAU | 44 | 4876-4896 | AUGUAAUAAUUUCUUCUGUUUCC | 175 | 4874-4896 |
| AD-112760 | AGCACUUUUACCAAACGUGAU | 45 | 5021-5041 | AUCACGUUUGGUAAAAGUGCUGU | 176 | 5019-5041 |
| AD-113137 | GAGAGAAUUUGUCUUACUAUU | 46 | 5443-5463 | AAUAGUAAGACAAAUUCUCUCAU | 177 | 5441-5463 |
| AD-113331 | GACAUUCACGUGGUUCACUUU | 47 | 5657-5677 | AAAGUGAACCACGUGAAUGUCUU | 178 | 5655-5677 |
| AD-114455 | CUGUGUUAAAUGUUAACAGUU | 48 | 6896-6916 | AACUGUUAACAUUUAACACAGCG | 179 | 6894-6916 |
| AD-114469 | ACAGUUUUCCACUAUUUCUCU | 21 | 6911-6931 | AGAGAAAUAGUGGAAAACUGUUA | 22 | 6909-6931 |
| AD-114478 | CUUUCUUUUCUAUUAGUGAAU | 49 | 6930-6950 | AUUCACUAAUAGAAAAGAAAGAG | 180 | 6928-6950 |
| AD-114698 | UUUCACAAACACAUGAUUUUU | 50 | 7211-7231 | AAAAAUCAUGUGUUUGUGAAAGU | 181 | 7209-7231 |
| AD-114728 | UACUUAAAAUAUCCUGUCUUU | 51 | 7283-7303 | AAAGACAGGAUAUUUUAAGUACU | 182 | 7281-7303 |
| AD-114746 | UUUCCCAUAUAACAAUGAUUU | 52 | 7301-7321 | AAAUCAUUGUUAUAUGGGAAAGA | 183 | 7299-7321 |
| AD-115217 | GUGUACAUAUAUCAAAAUGUU | 53 | 7936-7956 | AACAUUUUGAUAUAUGUACACGU | 184 | 7934-7956 |
| AD-115235 | CAACGAAAUUCAUAACAAUCU | 54 | 7986-8006 | AGAUUGUUAUGAAUUUCGUUGAU | 185 | 7984-8006 |
| AD-115563 | GAAACUACCAGAGUUACCUGU | 55 | 8322-8342 | ACAGGUAACUCUGGUAGUUUCUA | 186 | 8320-8342 |
| AD-115659 | CUUUCUUUUCAUGAUUCAUGU | 56 | 8437-8457 | ACAUGAAUCAUGAAAAGAAAGGA | 187 | 8435-8457 |
| AD-115814 | CGCAUGCUAAAUUUAAUGCUU | 57 | 8612-8632 | AAGCAUUAAAUUUAGCAUGCGGU | 188 | 8610-8632 |
| AD-115844 | CCUCUUGAAAUCCUUUAUUUU | 58 | 8642-8662 | AAAAUAAAGGAUUUCAAGAGGGU | 189 | 8640-8662 |
| AD-115919 | UCUCUUGAUCUAGAAUUUACU | 59 | 8755-8775 | AGUAAAUUCUAGAUCAAGAGAGA | 190 | 8753-8775 |
| AD-1410569 | CCACAAACUCAAGUUUGAAUU | 60 | 291-311 | AAUUCAAACUUGAGUUUGUGGGC | 191 | 289-311 |
| AD-1410577 | AUCUUUCUGUAACUUCCUUUU | 61 | 309-329 | AAAAGGAAGUUACAGAAAGAUUC | 192 | 307-329 |
| AD-1410605 | AGUAUGAACCAUAUUUUAAGU | 15 | 348-368 | ACUUAAAAUAUGGUUCAUACUCU | 16 | 346-368 |
| AD-1410628 | CUACCAUUUCAGGACUUCUUU | 62 | 384-404 | AAAGAAGUCCUGAAAUGGUAGAU | 193 | 382-404 |
| AD-1410662 | CAUCAUAAAAGUUCACUUUAU | 63 | 433-453 | AUAAAGUGAACUUUUAUGAUGUC | 194 | 431-453 |
| AD-1410700 | UCAAGGAAUUAGGUACAGUAU | 64 | 487-507 | AUACUGUACCUAAUUCCUUGAGG | 195 | 485-507 |
| AD-1410725 | UCUUACCUUGACCACACAUUU | 65 | 524-544 | AAAUGUGUGGUCAAGGUAAGAAG | 196 | 522-544 |

TABLE 2-continued

Unmodified Sense and Antisense Strand Sequences of
Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1410825 | UCACACACAUCUAUUACUCCU | 66 | 648-668 | AGGAGUAAUAGAUGUGUGUGAGG | 197 | 646-668 |
| AD-1410845 | UCUGAUCGAGGAUUUCAACUU | 67 | 676-696 | AAGUUGAAAUCCUCGAUCAGAUU | 198 | 674-696 |
| AD-1410880 | GACAAGCAAAUCGUGCUACUU | 68 | 767-787 | AAGUAGCACGAUUUGCUUGUCAA | 199 | 765-787 |
| AD-1410926 | CCCUAAUGUACACAGUCAAUU | 69 | 831-851 | AAUUGACUGUGUACAUUAGGGAU | 200 | 829-851 |
| AD-1410994 | AUUAUUCUCCAUUCAUUUCAU | 70 | 940-960 | AUGAAAUGAAUGGAGAAUAAUUC | 201 | 938-960 |
| AD-1411107 | CAGGCUUACAUUGACAUUAAU | 71 | 1106-1126 | AUUAAUGUCAAUGUAAGCCUGCA | 202 | 1104-1126 |
| AD-1411138 | CCAGGAAUCUUAAGAAAAUAU | 72 | 1143-1163 | AUAUUUUCUUAAGAUUCCUGGUU | 203 | 1141-1163 |
| AD-1411226 | UCAGCAUUUGGAUAAUUUCUU | 73 | 1276-1296 | AAGAAAUUAUCCAAAUGCUGAGA | 204 | 1274-1296 |
| AD-1411270 | UACGAAGAUGAGUCCUUCACU | 74 | 1340-1360 | AGUGAAGGACUCAUCUUCGUACU | 205 | 1338-1360 |
| AD-1411284 | CACCAAACAUACAGUGAAUCU | 75 | 1357-1377 | AGAUUCACUGUAUGUUUGGUGAA | 206 | 1355-1377 |
| AD-1411342 | ACACUCAAAAUCGUGUUCAAU | 76 | 1433-1453 | AUUGAACACGAUUUUGAGUGUGU | 207 | 1431-1453 |
| AD-1411387 | AUGAAGUCAACUCUUCUUUCU | 77 | 1515-1535 | AGAAAGAAGAGUUGACUUCAUCU | 208 | 1513-1535 |
| AD-1411480 | UAACAAGACCAUACUACAGUU | 78 | 1647-1667 | AACUGUAGUAUGGUCUUGUUAAG | 209 | 1645-1667 |
| AD-1411521 | AAUAGGACUACUUCUAAUCUU | 79 | 1702-1722 | AAGAUUAGAAGUAGUCCUAUUAG | 210 | 1700-1722 |
| AD-1411657 | AAACAUCAUGAGCACUAUCAU | 80 | 1894-1914 | AUGAUAGUGCUCAUGAUGUUUGA | 211 | 1892-1914 |
| AD-1411743 | CAUUCAUCUAUGGAAAGAGGU | 81 | 2034-2054 | ACCUCUUUCCAUAGAUGAAUGAG | 212 | 2032-2054 |
| AD-1411798 | UAACUUCCAUGAAUUCUAGUU | 82 | 2133-2153 | AACUAGAAUUCAUGGAAGUUAAC | 213 | 2131-2153 |
| AD-1411935 | GACUAUGAUUACCAGAACAGU | 83 | 2312-2332 | ACUGUUCUGGUAAUCAUAGUCAG | 214 | 2310-2332 |
| AD-1411972 | CCGAAACUCAUCAUUGAAUCU | 84 | 2362-2382 | AGAUUCAAUGAUGAGUUUCGGAA | 215 | 2360-2382 |
| AD-1412021 | ACUGAAUUCGUUUCUUCAAAU | 85 | 2429-2449 | AUUUGAAGAAACGAAUUCAGUGC | 216 | 2427-2449 |
| AD-1412040 | GUUGGUUCAAAUUAUUCUUCU | 86 | 2462-2482 | AGAAGAAUAAUUUGAACCAACAA | 217 | 2460-2482 |
| AD-1412052 | AGUUCACUGUCAAUAACCUUU | 87 | 2499-2519 | AAAGGUUAUUGACAGUGAACUUA | 218 | 2497-2519 |
| AD-1412095 | ACUCAGUUCUCAAUUCUUCCU | 88 | 2595-2615 | AGGAAGAAUUGAGAACUGAGUUC | 219 | 2593-2615 |
| AD-1412163 | UACGUCUACUUUCACUUGGUU | 89 | 2685-2705 | AACCAAGUGAAAGUAGACGUAUC | 220 | 2683-2705 |
| AD-1412250 | GGAUGAAAUUACUAGCACAUU | 90 | 2790-2810 | AAUGUGCUAGUAAUUUCAUCCAG | 221 | 2788-2810 |
| AD-1412364 | GUUACUCUUAAAACAAAGUAU | 91 | 2938-2958 | AUACUUUGUUUUAAGAGUAACAG | 222 | 2936-2958 |
| AD-1412429 | CUGAUGAAGACACAGCUGUUU | 92 | 3030-3050 | AAACAGCUGUGUCUUCAUCAGUA | 223 | 3028-3050 |
| AD-1412482 | CUAGAGUUAGACAUAAAUCUU | 93 | 3150-3170 | AAGAUUUAUGUCUAACUCUAGGA | 224 | 3148-3170 |
| AD-1412497 | CUCUACAAGUAAGACAGGAUU | 94 | 3168-3188 | AAUCCUGUCUUACUUGUAGAGAU | 225 | 3166-3188 |
| AD-1412539 | UUUCUCAUUAAGACACGAAAU | 95 | 3218-3238 | AUUUCGUGUCUUAAUGAGAAACU | 226 | 3216-3238 |
| AD-1412582 | UGAAGCCUACAACACAUUUUU | 96 | 3304-3324 | AAAAAUGUUGUAGGCUUCACU | 227 | 3302-3324 |
| AD-1412622 | AAUCCAUGAAACAUCUCUUU | 97 | 3360-3380 | AAAGAGAUGUUUCAUGGAUUUA | 228 | 3358-3380 |
| AD-1412683 | AUAACAGAAUUCCUCAAAUU | 98 | 3444-3464 | AAUUUGAGGAAUUCUGAUUAUGG | 229 | 3442-3464 |
| AD-1412721 | AGGAACACUAUCAAACAUUCU | 99 | 3516-3536 | AGAAUGUUUGAUAGUGUUCCUCU | 230 | 3514-3536 |
| AD-1412733 | UCAAAUGCACUCUACUUCAGU | 100 | 3553-3573 | ACUGAAGUAGAGUGCAUUUGAUC | 231 | 3551-3573 |
| AD-1412756 | UCAGUGAAAUGCUUGAGUAUU | 101 | 3603-3623 | AAUACUCAAGCAUUUCACUGAGC | 232 | 3601-3623 |

TABLE 2-continued

Unmodified Sense and Antisense Strand Sequences of
Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1412779 | UCCUCAGAACAUGAAGUCUGU | 102 | 3671-3691 | ACAGACUUCAUGUUCUGAGGAAG | 233 | 3669-3691 |
| AD-1412870 | CUCAUUCAGAGAAACCUUUCU | 103 | 3794-3814 | AGAAAGGUUUCUCUGAAUGAGUU | 234 | 3792-3814 |
| AD-1412963 | ACAACCCUUUCUCUAGACUUU | 104 | 3992-4012 | AAAGUCUAGAGAAAGGGUUGUAU | 235 | 3990-4012 |
| AD-1412982 | CUCCAGAACUCAGUCAAACAU | 105 | 4164-4184 | AUGUUUGACUGAGUUCUGGAGAG | 236 | 4162-4184 |
| AD-1413036 | UUGCAGAUCUCAGUCAAAUUU | 106 | 4326-4346 | AAAUUUGACUGAGAUCUGCAAAG | 237 | 4324-4346 |
| AD-1413128 | GACCUUGAUCAGAUAUUCUAU | 107 | 4520-4540 | AUAGAAUAUCUGAUCAAGGUCUG | 238 | 4518-4540 |
| AD-1413143 | UCUGAAUCUAGUCAGUCAUUU | 108 | 4544-4564 | AAAUGACUGACUAGAUUCAGAAG | 239 | 4542-4564 |
| AD-1413210 | CUAUCAAAGGAAUUUAAUCCU | 109 | 4652-4672 | AGGAUUAAAUUCCUUUGAUAGAA | 240 | 4650-4672 |
| AD-1413251 | UACAUUGAGAUCAUUCCAAAU | 110 | 4709-4729 | AUUUGGAAUGAUCUCAAUGUAAU | 241 | 4707-4729 |
| AD-1413286 | ACUAUGCUGAAAUUGAUUAUU | 111 | 4755-4775 | AAUAAUCAAUUUCAGCAUAGUCA | 242 | 4753-4775 |
| AD-1413311 | UAGGACAAACAUCAACUCCUU | 112 | 4807-4827 | AAGGAGUUGAUGUUUGUCCUAAC | 243 | 4805-4827 |
| AD-1413488 | UCGGAAUUCUUGGUCCUAUUU | 113 | 5067-5087 | AAAUAGGACCAAGAAUUCCGAGA | 244 | 5065-5087 |
| AD-1413517 | UUAUCCAAGUUCGUUUUAAAU | 114 | 5109-5129 | AUUUAAAACGAACUUGGAUAACA | 245 | 5107-5129 |
| AD-1413605 | AUGCUGUUCAGCCAAAUAGCU | 115 | 5238-5258 | AGCUAUUUGGCUGAACAGCAUUA | 246 | 5236-5258 |
| AD-1413615 | UAGCAGUUAUACCUACGUAUU | 116 | 5254-5274 | AAUACGUAGGUAUAACUGCUAUU | 247 | 5252-5274 |
| AD-1413936 | CUGGUUCAUUUAAAACUCUUU | 117 | 5742-5762 | AAAGAGUUUUAAAUGAACCAGGC | 248 | 5740-5762 |
| AD-1414009 | UGCAAACGCCAUUUCUUAUCU | 17 | 5832-5852 | AGAUAAGAAAUGGCGUUUGCAUC | 18 | 5830-5852 |
| AD-1414059 | AUAUCUGAUUCACAGAUCAAU | 118 | 5897-5917 | AUUGAUCUGUGAAUCAGAUAUGA | 249 | 5895-5917 |
| AD-1414074 | UCAGAGUUUCUGGGUUACUGU | 119 | 5921-5941 | ACAGUAACCCAGAAACUCUGAAG | 250 | 5919-5941 |
| AD-1414139 | AGAAUUUGCCUCUAAACCUUU | 120 | 6010-6030 | AAAGGUUUAGAGGCAAAUUCUGC | 251 | 6008-6030 |
| AD-1414232 | AUGUAGCUUACAGUUCCAACU | 121 | 6126-6146 | AGUUGGAACUGUAAGCUACUAG | 252 | 6124-6146 |
| AD-1414275 | GAAUGUGAUGUAUUUUAAUGU | 122 | 6184-6204 | ACAUUAAAAUACAUCACAUUCCU | 253 | 6182-6204 |
| AD-1414328 | UAGAUAUAUUAGGAUCUCUCU | 123 | 6259-6279 | AGAGAGAUCCUAAUAUAUCUAGC | 254 | 6257-6279 |
| AD-1414410 | UCACAGCUUCUUCGUUUAAGU | 124 | 6390-6410 | ACUUAAACGAAGAAGCUGUGAUU | 255 | 6388-6410 |
| AD-1414498 | AUUGAUCUACUCAAGAUCAAU | 125 | 6518-6538 | AUUGAUCUUGAGUAGAUCAAUUU | 256 | 6516-6538 |
| AD-1414544 | CCUCUGAAAUGUAUGUAAAGU | 126 | 6579-6599 | ACUUUACAUACAUUUCAGAGGAC | 257 | 6577-6599 |
| AD-1414625 | AAGGAAAUACUAAUACCAAAU | 127 | 6681-6701 | AUUUGGUAUUAGUAUUUCCUUCA | 258 | 6679-6701 |
| AD-1414662 | CAUUCCUAAAACAUGGAAUCU | 128 | 6754-6774 | AGAUUCCAUGUUUUAGGAAUGAC | 259 | 6752-6774 |
| AD-1414713 | AGACUCUUUAAGACCUCAAAU | 129 | 6848-6868 | AUUUGAGGUCUUAAAGAGUCUCU | 260 | 6846-6868 |
| AD-1414786 | AGAUAAUGGCUAUUACUUCUU | 130 | 7003-7023 | AAGAAGUAAUAGCCAUUAUCUUA | 261 | 7001-7023 |
| AD-1414796 | UUCUGCAUUAAUUUGAAUACU | 131 | 7019-7039 | AGUAUUCAAAUUAAUGCAGAAGU | 262 | 7017-7039 |
| AD-1414831 | AAGGGCUUAUCUUUCUUAAUU | 132 | 7069-7089 | AAUUAAGAAAGAUAAGCCCUUUU | 263 | 7067-7089 |
| AD-1414857 | CUCUUUUAAAUCCUUUACACU | 133 | 7141-7161 | AGUGUAAAGGAUUUAAAAGAGUU | 264 | 7139-7161 |
| AD-1414871 | CACUAGUAAAACAGAUAUUAU | 134 | 7160-7180 | AUAAUAUCUGUUUUACUAGUGUG | 265 | 7158-7180 |
| AD-1414931 | UUUCUGACUUUCCAUGAGUAU | 135 | 7321-7341 | AUACUCAUGGAAAGUCAGAAAAA | 266 | 7319-7341 |
| AD-1415052 | AAAACAUAAUUUCACCUACUU | 136 | 7532-7552 | AAGUAGGUGAAAUUAUGUUUUGA | 267 | 7530-7552 |
| AD-1415096 | CUGGUCUAAAUGCAGUUGUUU | 137 | 7589-7609 | AAACAACUGCAUUUAGACCAGCA | 268 | 7587-7609 |

TABLE 2-continued

Unmodified Sense and Antisense Strand Sequences of
Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1415166 | UCUCUUCUUCCAGCAACUUCU | 138 | 7696-7716 | AGAAGUUGCUGGAAGAAGAGA | 269 | 7694-7716 |
| AD-1415169 | UUUCAUCAUUCCUUUCCCUGU | 139 | 7719-7739 | ACAGGGAAAGGAAUGAUGAAGG | 270 | 7717-7739 |
| AD-1415194 | UUUAGACAUCCUUAAAAUCAU | 140 | 7787-7807 | AUGAUUUUAAGGAUGUCUAAAGG | 271 | 7785-7807 |
| AD-1415243 | UGAUUUAAUCAUCCUGUAACU | 141 | 7916-7936 | AGUUACAGGAUGAUUAAAUCAAG | 272 | 7914-7936 |
| AD-1415314 | GACUAAGAAACUCACUCGAAU | 142 | 8040-8060 | AUUCGAGUGAGUUUCUUAGUCCU | 273 | 8038-8060 |
| AD-1415327 | UCGAAACCACACAACUACAUU | 143 | 8055-8075 | AAUGUAGUUGUGUGGUUUCGAGU | 274 | 8053-8075 |
| AD-1415412 | ACAACAUACCAGAAUCUCUAU | 144 | 8170-8190 | AUAGAGAUUCUGGUAUGUUGUCU | 275 | 8168-8190 |
| AD-1415439 | GCAUUCUAUUCGUUGUGAACU | 145 | 8213-8233 | AGUUCACAACGAAUAGAAUGCAG | 276 | 8211-8233 |
| AD-1415466 | GUCUCGAUUCAGUGUAGAAGU | 146 | 8248-8268 | ACUUCUACACUGAAUCGAGACUG | 277 | 8246-8268 |
| AD-1415563 | AUCCACAAAACAUUGGCUUUU | 147 | 8393-8413 | AAAAGCCAAUGUUUUGUGGAUGU | 278 | 8391-8413 |
| AD-1415578 | CGUAUUCCCACUAUUCCUUUU | 148 | 8421-8441 | AAAAGGAAUAGUGGGAAUACGAA | 279 | 8419-8441 |
| AD-1415602 | CAUCAACAUUUCUAAGAUUUU | 149 | 8466-8486 | AAAAUCUUAGAAAUGUUGAUGGG | 280 | 8464-8486 |
| AD-1415633 | AAAACAUUUCUUUGUUUUCUU | 150 | 8527-8547 | AAGAAAACAAAGAAAUGUUUUCC | 281 | 8525-8547 |
| AD-1415663 | GUGAUCUGUUCAGUUGCAAAU | 151 | 8571-8591 | AUUUGCAACUGAACAGAUCACAC | 282 | 8569-8591 |
| AD-1415714 | AUUCGACAUUUCCAUUUUUCU | 152 | 8673-8693 | AGAAAAAUGGAAAUGUCGAAUUC | 283 | 8671-8693 |
| AD-1415738 | CUUCUCUACUCUGAAAUUGGU | 153 | 8727-8747 | ACCAAUUUCAGAGUAGAGAAGCC | 284 | 8725-8747 |
| AD-1415798 | GUUAUUCUCUACUUGAGAAAU | 154 | 8857-8877 | AUUUCUCAAGUAGAGAAUAACGA | 285 | 8855-8877 |
| AD-1415830 | UGUUAGUGUCAGAACUGAAAU | 155 | 8920-8940 | AUUUCAGUUCUGACACUAACAAG | 286 | 8918-8940 |
| AD-1415857 | UAUCCCUAGACUUUUAGUCUU | 156 | 8958-8978 | AAGACUAAAAGUCUAGGGAUAUG | 287 | 8956-8978 |
| AD-1415873 | UCUUCCAUAAAAUGAAACUUU | 157 | 8984-9004 | AAAGUUUCAUUUUAUGGAAGAGA | 288 | 8982-9004 |
| AD-1415881 | AUGUUUCUAAUCCAUUGCUCU | 158 | 9007-9027 | AGAGCAAUGGAUUAGAAACAUUA | 289 | 9005-9027 |
| AD-1415899 | GUAGACAUGAAUAUUAAUUGU | 159 | 9033-9053 | ACAAUUAAUAUUCAUGUCUACCU | 290 | 9031-9053 |
| AD-1415910 | GAUCUGGAAAAUACUUGUUUU | 160 | 9069-9089 | AAAACAAGUAUUUUCCAGAUCAA | 291 | 9067-9089 |
| AD-1415934 | CUGUGUAGAAAUAUUAAAACU | 161 | 9124-9144 | AGUUUUAAUAUUUCUACACAGCA | 292 | 9122-9144 |

TABLE 3

Modified Sense and Antisense Strand Sequences of
Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-109601 | asasagugGfaUfCfAfuaucuucucuL96 | 293 | asGfsagaAfgAfUfaugaUfcCfacuuuscsc | 427 | GGAAAGUGGAUCAUAUCUUCUCU | 561 |
| AD-109799 | uscsaaacCfaAfAfUfuggaaaacauL96 | 294 | asUfsguuUfuCfCfaauuUfgGfuuugasgsa | 428 | UCUCAAACCAAUUGGAAAACAU | 562 |
| AD-110052 | usasagugGfaAfCfAfucuuagaguuL96 | 295 | asAfscucUfaAfGfauguUfcCfacuuasusa | 429 | UAUAAGUGGAACAUCUUAGAGUU | 563 |

TABLE 3-continued

Modified Sense and Antisense Strand Sequences of
Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-110281 | gsasggacAfaCfAf UfcaacaaguuuL96 | 296 | asAfsacuUfgUfUfga ugUfuGfuccucsasa | 430 | UUGAGGACAAC AUCAACAAGU UU | 564 |
| AD-110370 | gscsauaaCfuAfCf UfcuuggauucuL96 | 297 | asGfsaauCfcAfAfga guAfgUfuaugcsusc | 431 | GAGCAUAACUA CUCUUGGAUU CU | 565 |
| AD-110518 | ususggaaCfuUfGf GfauguuaacuuL96 | 298 | asAfsguuAfaCfAfuc caAfgUfuccaascsa | 432 | UGUUGGAACUU GGAUGUUAAC UU | 566 |
| AD-110787 | gsasagaaGfaGfUf UfcaaucuuacuL96 | 299 | asGfsuaaGfaUfUfga acUfcUfucuucsusu | 433 | AAGAAGAAGAG UUCAAUCUUA CU | 567 |
| AD-110844 | uscsaaacAfcAfGf AfauauaauuguuL96 | 300 | asAfscaaUfaUfAfau cuGfuGfuuugasasg | 434 | CUUCAAACACA GAUAUAAUUG UU | 568 |
| AD-111287 | asasguaaCfuCfAf UfcuaagauuuuL96 | 301 | asAfsaauCfuUfAfga ugAfgUfuacuusasg | 435 | CAAAGUAACUC AUCUAAGAUU UU | 569 |
| AD-111345 | usasugaaAfuAfAf UfccaagauacuL96 | 302 | asGfsuauCfuUfGfga uuAfuUfucauasgsc | 436 | GCUAUGAAUA AUCCAAGAUA CU | 570 |
| AD-111483 | ascsugaaGfaAfAf AfgccaguuucuL96 | 303 | asGfsaaaCfuGfGfcu uuUfcUfucaguscsu | 437 | AGACUGAAGAA AAGCCAGUUU CU | 571 |
| AD-112322 | uscsauugCfuUfCf UfucaagaauuuL96 | 304 | asAfsauuCfuUfGfaa gaAfgCfaaugascsu | 438 | AGUCAUUGCUU CUUCAAGAAU UU | 572 |
| AD-112396 | usascucuCfaAfUf GfauacuuuucuL96 | 305 | asGfsaaaAfgUfAfuc auUfgAfgaguasgsg | 439 | CCUACUCUCAA UGAUACUUUUC U | 573 |
| AD-112618 | asasacagAfaGfAf AfauuauuacauL96 | 306 | asUfsguaAfuAfAfuu ucUfuCfuguuuscsc | 440 | GGAAACAGAAG AAAUUAUUAC AU | 574 |
| AD-112760 | asgscacuUfuUfAf CfcaaacgugauL96 | 307 | asUfscacGfuUfUfgg uaAfaAfgugcusgsu | 441 | ACAGCACUUUU ACCAAACGUGA U | 575 |
| AD-113137 | gsasgagaAfuUfUf GfucuuacuauuL96 | 308 | asAfsuagUfaAfGfac aaAfuUfcucucsasu | 442 | AUGAGAGAAUU UGUCUUACUA UU | 576 |
| AD-113331 | gsascauuCfaCfGf UfgguucacuuuL96 | 309 | asAfsaguGfaAfCfca cgUfgAfaugucsusu | 443 | AAGACAUUCAC GUGGUUCACU UU | 577 |
| AD-114455 | csusguguUfaAfAf UfguuaacaguuL96 | 310 | asAfscugUfuAfAfca uuUfaAfcacagscsg | 444 | CGCUGUGUUAA AUGUUAACAG UU | 578 |
| AD-114469 | ascsaguuUfuCfCf AfcuauuucucuL96 | 311 | asGfsagaAfaUfAfgu ggAfaAfacugususa | 445 | UAACGUUUUC CACUAUUUCUC U | 579 |
| AD-114478 | csusuucuUfuUfCf UfauuagugaauL96 | 312 | asUfsucaCfuAfAfua gaAfaAfgaaagsasg | 446 | CUCUUUCUUUU CUAUUAGUGA AU | 580 |
| AD-114698 | ususucacAfaAfCf AfcaugauuuuuL96 | 313 | asAfsaaaUfcAfUfgu guUfuGfugaaasgsu | 447 | ACUUUCACAAA CACAUGAUUU UU | 581 |

TABLE 3-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
| --- | --- | --- | --- | --- | --- | --- |
| AD-114728 | usascuuaAfaAfAfUf AfuccugucuuuL96 | 314 | asAfsagaCfaGfGfau auUfuUfaaguascsu | 448 | AGUACUUAAAA UAUCCUGUCU UU | 582 |
| AD-114746 | ususcccAfuAfAfUf AfacaaugauuuL96 | 315 | asAfsaucAfuUfUfGfuu auAfuGfggaaasgsa | 449 | UCUUUCCCAUA UAACAAUGAU UU | 583 |
| AD-115217 | gsusguacAfuAfAfUf AfucaaaauguuL96 | 316 | asAfscauUfuUfUfGfau auAfuGfuacacsgsu | 450 | ACGUGUACAUA UAUCAAAAUG UU | 584 |
| AD-115235 | csasacgaAfaUfUfUf CfauaacaaucuL96 | 317 | asGfsauuGfuUfUfAfug aaUfuUfcguugsasu | 451 | AUCAACGAAAU UCAUAACAAU CU | 585 |
| AD-115563 | gsasaacuAfcCfAf GfaguuaccuguL96 | 318 | asCfsaggUfaAfCfuc ugGfuAfguuucsusa | 452 | UAGAAACUACC AGAGUUACCU GU | 586 |
| AD-115659 | csusuucuUfuUfCf AfugauucauguL96 | 319 | asCfsaugAfaUfCfau gaAfaAfgaaagsgsa | 453 | UCCUUUCUUUU CAUGAUUCAU GU | 587 |
| AD-115814 | csgscaugCfuAfAf AfuuuaaugcuuL96 | 320 | asAfsgcaUfaAfAfau uuAfgCfaugcgsgsu | 454 | ACCGCAUGCUA AAUUUAAUGC UU | 588 |
| AD-115844 | cscsucuuGfaAfAf UfccuuuauuuL96 | 321 | asAfsaauAfaAfAfGfga uuUfcAfagagggsu | 455 | ACCCUCUUGAA AUCCUUUAUUU U | 589 |
| AD-115919 | uscsucuuGfaUfCf UfagaauuuacuL96 | 322 | asGfsuaaAfuUfCfua gaUfcAfagagasgsa | 456 | UCUCUCUUGAU CUAGAAUUUA CU | 590 |
| AD-1410569 | cscsacaaAfcUfCf AfaguuugaauuL96 | 323 | asAfsuucAfaAfCfuu gaGfuUfuguggsgsc | 457 | GCCCACAAACU CAAGUUUGAAU C | 591 |
| AD-1410577 | asuscuuuCfuGfUf AfacuuccuuuuL96 | 324 | asAfsaagGfaAfGfuu acAfgAfaagausus | 458 | GAAUCUUUCUG UAACUUCCUU UA | 592 |
| AD-1410605 | asgsuaugAfaCfCf AfuauuuuaaguL96 | 325 | asCfsuuaAfaAfUfau ggUfuCfauacuscsu | 459 | AGAGUAUGAAC CAUAUUUUAA GA | 593 |
| AD-1410628 | csusaccaUfuUfCf AfggacuucuuuL96 | 326 | asAfsagaAfgUfCfcu gaAfaUfgguagsasu | 460 | AUCUACCAUUU CAGGACUUCUU G | 594 |
| AD-1410662 | csasucauAfaAfAf GfuucacuuuauL96 | 327 | asUfsaaaGfuGfAfac uuUfuAfugausus | 461 | GACAUCAUAAA AGUUCACUUU AA | 595 |
| AD-1410700 | uscsaaggAfaUfUf AfgguacaguauL96 | 328 | asUfsacuGfuAfCfcu aaUfuCfcuugasgsg | 462 | CCUCAAGGAAU UAGGUACAGU AA | 596 |
| AD-1410725 | uscsuuacCfuUfGf AfccacacauuuL96 | 329 | asAfsaugUfgUfGfgu caAfgGfuaagasasg | 463 | CUUCUUACCUU GACCACACAUU C | 597 |
| AD-1410825 | uscsacacAfcUfUf CfuauuacucuL96 | 330 | asGfsgagUfaAfUfag auGfuGfugugasgsg | 464 | CCUCACACACA UCUAUUACUCC C | 598 |
| AD-1410845 | uscsugauCfgAfGfGf GfauuucaacuuL96 | 331 | asAfsguuGfaAfAfuc cuCfgAfucagasusu | 465 | AAUCUGAUCGA GGAUUUCAAC UC | 599 |

TABLE 3-continued

Modified Sense and Antisense Strand Sequences of
Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1410880 | gsascaagCfaAfAf UfcgugcuacuuL96 | 332 | asAfsguaGfcAfCfga uuUfgCfuugucsasa | 466 | UUGACAAGCAA AUCGUGCUAC UA | 600 |
| AD-1410926 | cscscuaaUfgUfAf CfacagucaauuL96 | 333 | asAfsuugAfcUfGfug uaCfaUfuagggsasu | 467 | AUCCCUAAUGU ACACAGUCAAU G | 601 |
| AD-1410994 | asusuauuCfuCfCf AfuucauuucauL96 | 334 | asUfsgaaAfuGfAfau ggAfgAfauaaususc | 468 | GAAUUAUUCUC CAUUCAUUUC AA | 602 |
| AD-1411107 | csasggcuUfaCfAf UfugacauuaauL96 | 335 | asUfsuaaUfgUfCfaa ugUfaAfgccugscsa | 469 | UGCAGGCUUAC AUUGACAUUA AA | 603 |
| AD-1411138 | cscsaggaAfuCfUf UfaagaaaauauL96 | 336 | asUfsauuUfcUfUfua agAfuUfccuggsusu | 470 | AACCAGGAAUC UUAAGAAAAU AA | 604 |
| AD-1411226 | uscsagcaUfuUfGf GfauaauuucuuL96 | 337 | asAfsgaaAfuUfAfuc caAfaUfgcugasgsa | 471 | UCUCAGCAUUU GGAUAAUUUC UC | 605 |
| AD-1411270 | usascgaaGfaUfGf AfguccuucacuL96 | 338 | asGfsugaAfgGfAfcu caUfcUfucguascsu | 472 | AGUACGAAGAU GAGUCCUUCA CC | 606 |
| AD-1411284 | csasccaaAfcAfUf AfcagugaaucuL96 | 339 | asGfsauuCfaCfUfgu auGfuUfuggugsasa | 473 | UUCACCAAACA UACAGUGAAUC | 607 |
| AD-1411342 | ascsacucAfaAfAf UfcguguucaauL96 | 340 | asUfsugaAfcAfCfga uuUfuGfagugusgsu | 474 | ACACACUCAAA AUCGUGUUCAA A | 608 |
| AD-1411387 | asusgaagUfcAfAf CfucuucuuucuL96 | 341 | asGfsaaaGfaAfGfag uuGfaCfuucauscsu | 475 | AGAUGAAGUCA ACUCUUCUUU CA | 609 |
| AD-1411480 | usasacaaGfaCfCf AfuacuacaguuL96 | 342 | asAfscugUfaGfUfau ggUfcUfuguuasasg | 476 | CUUAACAAGAC CAUACUACAGU G | 610 |
| AD-1411521 | asasuaggAfcUfAf CfuucuaaucuuL96 | 343 | asAfsgauUfaGfAfag uaGfuCfcuauusasg | 477 | CUAAUAGGACU ACUUCUAAUC UG | 611 |
| AD-1411657 | asasacauCfaUfGf AfgcacuaucauL96 | 344 | asUfsgauAfgUfGfcu caUfgAfuguuusga | 478 | UCAAACAUCAU GAGCACUAUCA A | 612 |
| AD-1411743 | csasuucaUfcUfAf UfggaaagagguL96 | 345 | asCfscucUfuUfCfca uaGfaUfgaaugsasg | 479 | CUCAUUCAUCU AUGGAAAGAG GC | 613 |
| AD-1411798 | usasacuuCfcUfUf GfaauucuaguuL96 | 346 | asAfscuaGfaAfUfuc auGfgAfaguuasasc | 480 | GUUAACUUCCA UGAAUUCUAG UC | 614 |
| AD-1411935 | gsascuauGfaUfUf AfccagaacaguL96 | 347 | asCfsuguUfcUfGfgu aaUfcAfuagucsasg | 481 | CUGACUAUGAU UACCAGAACA GA | 615 |
| AD-1411972 | cscsgaaaCfuCfAf UfcauugaaucuL96 | 348 | asGfsauuCfaAfUfga ugAfgUfuucggsasa | 482 | UUCCGAAACUC AUCAUUGAAUC A | 616 |
| AD-1412021 | ascsugaaUfuCfGf UfuucuucaaauL96 | 349 | asUfsuugAfaGfAfaa cgAfaUfucagusgsc | 483 | GCACUGAAUUC GUUUCUUCAA AC | 617 |

TABLE 3-continued

Modified Sense and Antisense Strand Sequences of
Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1412040 | gsusugguUfcAfAf AfuuauucuucuL96 | 350 | asGfsaagAfaUfAfau uuGfaAfccaacsasa | 484 | UUGUUGGUUCA AAUUAUUCUU CC | 618 |
| AD-1412052 | asgsuucaCfuGfUf CfaauaaccuuuL96 | 351 | asAfsaggUfuAfUfug acAfgUfgaacususa | 485 | UAAGUUCACUG UCAAUAACCU UG | 619 |
| AD-1412095 | ascsucagUfuCfUf CfaauucuuccuL96 | 352 | asGfsgaaGfaAfUfug agAfaCfugagususc | 486 | GAACUCAGUUC UCAAUUCUUCC A | 620 |
| AD-1412163 | usascgucUfaCfUf UfucacuugguuL96 | 353 | asAfsccaAfgUfGfaa agUfaGfacguasusc | 487 | GAUACGUCUAC UUUCACUUGG UG | 621 |
| AD-1412250 | gsgsaugaAfaUfUf AfcuagcacauuL96 | 354 | asAfsuguGfcUfAfgu aaUfuUfcauccsasg | 488 | CUGGAUGAAAU UACUAGCACA UA | 622 |
| AD-1412364 | gsusuacuCfuUfAf AfaacaaaguauL96 | 355 | asUfsacuUfuGfUfuu uaAfgAfguaacsasg | 489 | CUGUUACUCUU AAAACAAAGU AA | 623 |
| AD-1412429 | csusgaugAfaGfAf CfacagcuguuuL96 | 356 | asAfsacaGfcUfGfug ucUfuCfaucagsusa | 490 | UACUGAUGAAG ACACAGCUGU UA | 624 |
| AD-1412482 | csusagagUfuAfGfAf AfcauaaaucuuL96 | 357 | asAfsgauUfuAfUfgu cuAfaCfucuagsgsa | 491 | UCCUAGAGUUA GACAUAAAUC UC | 625 |
| AD-1412497 | csuscuacAfaGfUf AfagacaggauuL96 | 358 | asAfsuccUfgUfCfuu acUfuGfuagagsasu | 492 | AUCUCUACAAG UAAGACAGGA UG | 626 |
| AD-1412539 | ususucucAfuUfAf AfgacacgaaauL96 | 359 | asUfsuucGfuGfUfcu uaAfuGfagaaascsu | 493 | AGUUUCUCAUU AAGACACGAA AA | 627 |
| AD-1412582 | usgsaagcCfuAfCf AfacacauuuuL96 | 360 | asAfsaaaUfgUfGfuu guAfgGfcuucascsu | 494 | AGUGAAGCCUA CAACACAUUU UC | 628 |
| AD-1412622 | asasuccaAfuGfAf AfacaucucuuuL96 | 361 | asAfsagaGfaUfGfuu ucAfuUfggauususa | 495 | UAAAUCCAAUG AAACAUCUCU UC | 629 |
| AD-1412683 | asusaaucAfgAfAf UfccucaaauuL96 | 362 | asAfsuuuGfaGfGfaa uuCfuGfauuausgsg | 496 | CCAUAAUCAGA AUUCCUCAAAU G | 630 |
| AD-1412721 | asgsgaacAfcUfAf UfcaaacauucuL96 | 363 | asGfsaauGfuUfUfga uaGfuGfuuccuscsu | 497 | AGAGGAACACU AUCAAACAUU CC | 631 |
| AD-1412733 | uscsaaauGfcAfCfCf UfcuacuucaguL96 | 364 | asCfsugaAfgUfAfga guGfcAfuuugasusc | 498 | GAUCAAAUGCA CUCUACUUCAG A | 632 |
| AD-1412756 | uscsagugAfaAfUf GfcuugaguauuL96 | 365 | asAfsuacUfcAfAfgc auUfuCfacugasgsc | 499 | GCUCAGUGAAA UGCUUGAGUA UG | 633 |
| AD-1412779 | uscscucaGfaAfCf AfugaagucuguL96 | 366 | asCfsagaCfuUfCfau guUfcUfgaggasasg | 500 | CUUCCUCAGAA CAUGAAGUCU G | 634 |
| AD-1412870 | csuscauuCfaGfAf AfaccuuucuuL96 | 367 | asGfsaaaAfgGfUfUfuc ucUfgAfaugagsusu | 501 | AACUCAUUCAG AGAAACCUUUC C | 635 |

TABLE 3-continued

Modified Sense and Antisense Strand Sequences of
Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1412963 | ascsaaccCfuUfUf CfucuagacuuuL96 | 368 | asAfsaguCfuAfGfag aaAfgGfguugusasu | 502 | AUACAACCCUU UCUCUAGACUU C | 636 |
| AD-1412982 | csusccagAfaCfUf CfagucaaacauL96 | 369 | asUfsguuUfgAfCfug agUfuCfuggagsasg | 503 | CUCUCCAGAAC UCAGUCAAACA A | 637 |
| AD-1413036 | ususgcagAfuCfUf CfagucaaauuuL96 | 370 | asAfsauuUfgAfCfug agAfuCfugcaasasg | 504 | CUUUGCAGAUC UCAGUCAAAU UC | 638 |
| AD-1413128 | gsasccuuGfaUfCf AfgauauucuauL96 | 371 | asUfsagaAfuAfUfcu gaUfcAfaggucsusg | 505 | CAGACCUUGAU CAGAUAUUCU AC | 639 |
| AD-1413143 | uscsugaaUfcUfAf GfucagucauuuL96 | 372 | asAfsaugAfcUfGfac uaGfaUfucagasasg | 506 | CUUCUGAAUCU AGUCAGUCAU UG | 640 |
| AD-1413210 | cssaucaAfaGfGf AfauuuaauccuL96 | 373 | asGfsgauUfaAfAfuu ccUfuUfgauagsasa | 507 | UUCUAUCAAAG GAAUUUAAUC CA | 641 |
| AD-1413251 | usascauuGfaGfAf UfcauuccaaauL96 | 374 | asUfsuugGfaAfUfga ucUfcAfauguasasu | 508 | AUUACAUUGAG AUCAUUCCAA AG | 642 |
| AD-1413286 | ascsuaugCfuGfAf AfauugauuauuL96 | 375 | asAfsuaaUfcAfAfuu ucAfgCfauaguscsa | 509 | UGACUAUGCUG AAAUUGAUUA UG | 643 |
| AD-1413311 | usasggacAfaAfCf AfucaacuccuuL96 | 376 | asAfsggaGfuUfGfau guUfuGfuccuasasc | 510 | GUUAGGACAAA CAUCAACUCCU C | 644 |
| AD-1413488 | uscsggaaUfuCfUf UfgguccuauuuL96 | 377 | asAfsauaGfgAfCfca agAfaUfuccgasgsa | 511 | UCUCGGAAUUC UUGGUCCUAU UA | 645 |
| AD-1413517 | ususauccAfaGfUf UfcguuuuaaauL96 | 378 | asUfsuuaAfaAfCfga acUfuGfgauaascsa | 512 | UGUUACCAAG UUCGUUUUAA AA | 646 |
| AD-1413605 | asusgcugUfuCfAf GfccaaauagcuL96 | 379 | asGfscuaUfuUfGfgc ugAfaCfagcaususa | 513 | UAAUGCUGUUC AGCCAAAUAG CA | 647 |
| AD-1413615 | usasgcagUfuAfUf AfccuacguauuL96 | 380 | asAfsuacGfuAfGfgu auAfaCfugcuasusu | 514 | AAUAGCAGUUA UACCUACGUA UG | 648 |
| AD-1413936 | csusgguuCfaUfUf UfaaaacucuuuL96 | 381 | asAfsagaGfuUfUfua aaUfgAfaccagsgsc | 515 | GCCUGGUUCAU UUAAAACUCU UG | 649 |
| AD-1414009 | usgscaaaCfgCfCf AfuuucuuaucuL96 | 382 | asGfsauaAfgAfAfau ggCfgUfuugcasusc | 516 | GAUGCAAACGC CAUUUCUUAUC A | 650 |
| AD-1414059 | asusaucuGfaUfUf CfacagaucaauL96 | 383 | asUfsugaUfcUfGfug aaUfcAfgauausgsa | 517 | UCAUAUCUGAU UCACAGAUCA AG | 651 |
| AD-1414074 | uscsagagUfuUfCf UfgggguuacuguL96 | 384 | asCfsaguAfaCfCfca gaAfaCfucugasasg | 518 | CUUCAGAGUUU CUGGGUUACU GG | 652 |
| AD-1414139 | asgsaauuUfgCfCf UfcuaaaccuuuL96 | 385 | asAfsaggUfuUfAfga ggCfaAfauuscsgsc | 519 | GCAGAAUUUGC CUCUAAACCU G | 653 |

TABLE 3-continued

Modified Sense and Antisense Strand Sequences of
Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1414232 | asusguagCfuUfAf CfaguuccaacuL96 | 386 | asGfsuugGfaAfCfug uaAfgCfuacausasg | 520 | CUAUGUAGCUU ACAGUUCCAAC C | 654 |
| AD-1414275 | gsasauguGfaUfGf UfauuuuaauguL96 | 387 | asCfsauuAfaAfAfua caUfcAfcauucscsu | 521 | AGGAAUGUGAU GUAUUUUAAU GG | 655 |
| AD-1414328 | usasgauaUfaUfUf AfggaucucucuL96 | 388 | asGfsagaGfaUfCfcu aaUfaUfaucuasgsc | 522 | GCUAGAUAUAU UAGGAUCUCU CC | 656 |
| AD-1414410 | uscsacagCfuUfCf UfucguuuaaguL96 | 389 | asCfsuuaAfaCfGfaa gaAfgCfugugasusu | 523 | AAUCACAGCUU CUUCGUUUAA GA | 657 |
| AD-1414498 | asusugauCfuAfCf UfcaagaucaauL96 | 390 | asUfsugaUfcUfUfga guAfgAfucaaususu | 524 | AAAUUGAUCUA CUCAAGAUCA AG | 658 |
| AD-1414544 | cscsucugAfaAfUf GfuauguaaaguL96 | 391 | asCfsuuuAfcAfUfac auUfuCfagaggsasc | 525 | GUCCUCUGAAA UGUAUGUAAA GA | 659 |
| AD-1414625 | asasggaaAfuAfCf UfaauaccaaauL96 | 392 | asUfsuugGfuAfUfua guAfuUfuccuuscsa | 526 | UGAAGGAAAUA CUAAUACCAA AG | 660 |
| AD-1414662 | csasuuccUfaAfAf AfcauggaaucuL96 | 393 | asGfsauuCfcAfUfgu uuUfaGfgaaugsasc | 527 | GUCAUUCCUAA AACAUGGAAU CA | 661 |
| AD-1414713 | asgsacucUfuUfAf AfgaccucaaauL96 | 394 | asUfsuugAfgGfUfcu uaAfaGfagucscsu | 528 | AGAGACUCUUU AAGACCUCAA AC | 662 |
| AD-1414786 | asgsauaaUfgGfCf UfauuacuucuuL96 | 395 | asAfsgaaGfuAfAfua gcCfaUfuaucususa | 529 | UAAGAUAAUGG CUAUUACUUC UG | 663 |
| AD-1414796 | ususcugcAfuUfAf AfuuugaauacuL96 | 396 | asGfsuauUfcAfAfau uaAfuGfcagaasgsu | 530 | ACUUCUGCAUU AAUUUGAAUA CA | 664 |
| AD-1414831 | asasgggcUfuUfAf CfuuucuuaauuL96 | 397 | asAfsuuaAfgAfAfag auAfaGfcccuususu | 531 | AAAAGGGCUUA UCUUUCUUAA UG | 665 |
| AD-1414857 | csuscuuuUfaAfAf UfccuuuacacuL96 | 398 | asGfsuguAfaAfGfga uuUfaAfaagagsusu | 532 | AACUCUUUUAA AUCCUUUACAC A | 666 |
| AD-1414871 | csascuagUfaAfAf AfcagauauuauL96 | 399 | asUfsaauAfuCfUfgu uuUfaCfuagugsusg | 533 | CACACUAGUAA AACAGAUAUU AC | 667 |
| AD-1414931 | ususucugAfcUfUf UfccaugaguauL96 | 400 | asUfsacuCfaUfGfga aaGfuCfagaaasasa | 534 | UUUUUCUGACU UUCCAUGAGU AA | 668 |
| AD-1415052 | asasaacaUfaUfUf UfucaccuacuuL96 | 401 | asAfsguaGfgUfGfaa auUfaUfguuuusgsa | 535 | UCAAAACAUAA UUUCACCUAC UG | 669 |
| AD-1415096 | csusgggucUfaAfAf UfgcaguguuuL96 | 402 | asAfsacaAfcUfGfca uuUfaGfaccagscsa | 536 | UGCUGGUCUAA AUGCAGUUGU UC | 670 |
| AD-1415166 | uscsucuuCfuUfCf CfagcaacuucuL96 | 403 | asGfsaagUfuGfCfug gaAfgAfagagasgsa | 537 | UCUCUCUUCUU CCAGCAACUU C | 671 |

TABLE 3-continued

Modified Sense and Antisense Strand Sequences of
Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1415169 | ususucauCfaUfUf Cfcuuucccugu L96 | 404 | asCfsaggGfaAfAfgg aaUfgAfugaaasgsg | 538 | CCUUUCAUCAU UCCUUUCCCUG G | 672 |
| AD-1415194 | ususuagaCfaUfCf Cfuuaaaaucau L96 | 405 | asUfsgauUfuUfAfag gaUfgUfcuaaasgsg | 539 | CCUUUAGACAU CCUUAAAAUCA C | 673 |
| AD-1415243 | usgsauuuAfaUfCf AfuccuguaacuL96 | 406 | asGfsuuaCfaGfGfau gaUfuAfaaucasasg | 540 | CUUGAUUUAAU CAUCCUGUAA CG | 674 |
| AD-1415314 | gsascuaaGfaAfAf CfucacucgaauL96 | 407 | asUfsucgAfgUfGfag uuUfcUfuagucscsu | 541 | AGGACUAAGAA ACUCACUCGA AA | 675 |
| AD-1415327 | uscsgaaaCfcAfCf AfcaacuacauuL96 | 408 | asAfsuguAfgUfUfgu guGfgUfuucgasgsu | 542 | ACUCGAAACCA CACAACUACAU G | 676 |
| AD-1415412 | ascsaacaUfaCfCf AfgaaucucuauL96 | 409 | asUfsagaGfaUfUfcu ggUfaUfguuguscsu | 543 | AGACAACAUAC CAGAAUCUCUA G | 677 |
| AD-1415439 | gscsauucUfaUfUf CfguugugaacuL96 | 410 | asGfsuucAfcAfAfcg aaUfaGfaaugcsasg | 544 | CUGCAUUCUAU UCGUUGUGAA CA | 678 |
| AD-1415466 | gsuscucgAfuUfCf AfguguagaaguL96 | 411 | asCfsuucUfaCfAfcu gaAfuCfgagacsusg | 545 | CAGUCUCGAUU CAGUGUAGAA GG | 679 |
| AD-1415563 | asusccacAfaAfAf CfauggcuuuuL96 | 412 | asAfsaagCfcAfAfug uuUfuGfuggausgsu | 546 | ACAUCCACAAA ACAUGGCUUU C | 680 |
| AD-1415578 | csgsuauuCfcCfAf CfuauccuuuuL96 | 413 | asAfsaagGfaAfUfag ugGfgAfauacgsasa | 547 | UUCGUAUUCCC ACUAUUCCUUU C | 681 |
| AD-1415602 | csasucaaCfaUfUf UfcuaagauuuL96 | 414 | asAfsaauCfuUfAfga aaUfgUfugaugsgsg | 548 | CCCAUCAACAU UUCUAAGAUUU C | 682 |
| AD-1415633 | asasaacaUfuUfCf UfuuguuuucuuL96 | 415 | asAfsgaaAfaCfAfaa gaAfaUfguuuuscsc | 549 | GGAAAACAUUU CUUUGUUUUC UA | 683 |
| AD-1415663 | gsusgaucUfgUfUf CfaguugcaaauL96 | 416 | asUfsuugCfaAfCfug aaCfaGfaucacsasc | 550 | GUGUGAUCUGU UCAGUUGCAA AG | 684 |
| AD-1415714 | asusucgaCfaUfUf UfccauuuucuL96 | 417 | asGfsaaaAfaUfGfga aaUfgUfcgaaususc | 551 | GAAUUCGACAU UUCCAUUUUU CA | 685 |
| AD-1415738 | csusucucUfaCfUf CfugaaauugguL96 | 418 | asCfscaaUfuUfCfag agUfaGfagaagscsc | 552 | GGCUUCUCUAC UCUGAAAUUG GG | 686 |
| AD-1415798 | gsusuauuCfuCfUf AfcuugagaaauL96 | 419 | asUfsuucUfcAfAfgu agAfgAfauaacsgsa | 553 | UCGUUAUUCUC UACUUGAGAA AA | 687 |
| AD-1415830 | usgsuuagUfgUfCf AfgaacugaaauL96 | 420 | asUfsuucAfgUfUfcu gaCfaCfuaacasasg | 554 | CUUGUUAGUGU CAGAACUGAA AC | 688 |
| AD-1415857 | usasucccUfaGfAf CfuuuuagucuuL96 | 421 | asAfsgacUfaAfAfag ucUfaGfggauasusg | 555 | CAUAUCCCUAG ACUUUUAGUCU G | 689 |

TABLE 3-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1415873 | uscsuuccAfuAfAf AfaugaaacuuuL96 | 422 | asAfsaguUfuCfAfuu uuAfuGfgaagasgsa | 556 | UCUCUUCCAUA AAAUGAAACU UA | 690 |
| AD-1415881 | asusguuuCfuAfAf UfccauugcucuL96 | 423 | asGfsagcAfaUfGfga uuAfgAfaacaususa | 557 | UAAUGUUUCUA AUCCAUUGCU CA | 691 |
| AD-1415899 | gsusagacAfuGfAf AfuauuaauuguL96 | 424 | asCfsaauUfaAfUfau ucAfuGfucuacscsu | 558 | AGGUAGACAUG AAUAUUAAUU GA | 692 |
| AD-1415910 | gsasucugGfaAfAf AfuacuuguuuL96 | 425 | asAfsaacAfaGfUfau uuUfcCfagaucsasa | 559 | UUGAUCUGGAA AAUACUUGUU UG | 693 |
| AD-1415934 | csusguguAfgAfAf AfuauuaaaacuL96 | 426 | asGfsuuuUfaAfUfau uuCfuAfcacagscsa | 560 | UGCUGUGUAGA AAUAUUAAAA CC | 694 |

TABLE 4

Coagulation Factor V Single Dose Screens in Hep3b cells

| Duplex Name | % mRNA FV/GAPDH | Std Dev. |
|---|---|---|
| AD-1415934.1 | 75.3 | 3.0 |
| AD-1415910.1 | 85.0 | 11.7 |
| AD-1415899.1 | 78.6 | 0.9 |
| AD-1415881.1 | 85.2 | 2.8 |
| AD-1415873.1 | 75.0 | 1.0 |
| AD-1415857.1 | 83.3 | 2.6 |
| AD-1415830.1 | 72.0 | 1.0 |
| AD-1415798.1 | 83.5 | 1.5 |
| AD-115919.1 | 90.2 | 9.2 |
| AD-1415738.1 | 88.6 | 4.4 |
| AD-1415714.1 | 97.7 | 17.7 |
| AD-115844.1 | 89.0 | 5.6 |
| AD-115814.1 | 76.5 | 2.7 |
| AD-1415663.1 | 83.9 | 2.3 |
| AD-1415633.1 | 84.2 | 7.8 |
| AD-1415602.1 | 92.9 | 3.0 |
| AD-115659.1 | 79.9 | 3.7 |
| AD-1415578.1 | 89.4 | 3.4 |
| AD-1415563.1 | 91.8 | 12.5 |
| AD-115563.1 | 91.7 | 5.1 |
| AD-1415466.1 | 89.5 | 4.1 |
| AD-1415439.1 | 76.9 | 3.3 |
| AD-1415412.1 | 84.4 | 3.7 |
| AD-1415327.1 | 87.9 | 2.1 |
| AD-1415314.1 | 91.6 | 2.8 |
| AD-115235.1 | 87.6 | 2.6 |
| AD-115217.1 | 89.8 | 1.9 |
| AD-1415243.1 | 89.0 | 2.2 |
| AD-1415194.1 | 91.2 | 1.7 |
| AD-1415169.1 | 100.4 | 7.2 |
| AD-1415166.1 | 85.1 | 5.7 |
| AD-1415096.1 | 94.2 | 6.2 |
| AD-1415052.1 | 101.4 | 4.7 |
| AD-1414931.1 | 93.8 | 4.9 |
| AD-114746.1 | 101.6 | 9.0 |
| AD-114728.1 | 102.5 | 3.3 |
| AD-114698.1 | 95.9 | 0.6 |
| AD-1414871.1 | 94.1 | 2.1 |
| AD-1414857.1 | 104.1 | 1.6 |
| AD-1414831.1 | 87.3 | 3.6 |
| AD-1414796.1 | 87.9 | 10.3 |
| AD-1414786.1 | 89.5 | 6.4 |
| AD-114478.1 | 22.9 | 4.0 |
| AD-114469.1 | 15.8 | 0.9 |
| AD-114455.1 | 18.4 | 1.9 |
| AD-1414713.1 | 21.3 | 1.5 |
| AD-1414662.1 | 22.3 | 3.7 |
| AD-1414625.1 | 23.7 | 2.6 |
| AD-1414544.1 | 18.8 | 2.8 |
| AD-1414498.1 | 103.0 | 6.0 |
| AD-1414410.1 | 16.0 | 1.6 |
| AD-1414328.1 | 17.6 | 2.5 |
| AD-1414275.1 | 16.7 | 1.6 |
| AD-1414232.1 | 17.6 | 1.2 |
| AD-1414139.1 | 20.5 | 1.0 |
| AD-1414074.1 | 42.0 | 6.1 |
| AD-1414059.1 | 26.1 | 2.1 |
| AD-1414009.1 | 21.4 | 1.7 |
| AD-1413936.1 | 17.4 | 2.8 |
| AD-113331.1 | 28.2 | 2.2 |
| AD-113137.1 | 16.1 | 3.0 |
| AD-1413615.1 | 21.8 | 2.6 |
| AD-1413605.1 | 21.7 | 2.9 |
| AD-1413517.1 | 16.9 | 1.3 |
| AD-1413488.1 | 24.3 | 2.9 |
| AD-112760.1 | 20.0 | 2.6 |
| AD-112618.1 | 17.0 | 1.7 |
| AD-1413311.1 | 13.3 | 1.3 |
| AD-1413286.1 | 13.3 | 1.9 |
| AD-1413251.1 | 23.8 | 4.5 |
| AD-1413210.1 | 17.5 | 3.1 |
| AD-112396.1 | 10.3 | 1.3 |
| AD-112322.1 | 14.1 | 1.5 |
| AD-1413143.1 | 16.2 | 1.6 |
| AD-1413128.1 | 11.9 | 3.4 |
| AD-1413036.1 | 44.5 | 4.6 |
| AD-1412982.1 | 12.9 | 1.1 |
| AD-1412963.1 | 18.8 | 0.4 |
| AD-1412870.1 | 24.9 | 1.8 |
| AD-1412779.1 | 25.4 | 1.2 |
| AD-1412756.1 | 21.0 | 2.9 |
| AD-1412733.1 | 20.7 | 0.9 |
| AD-1412721.1 | 17.7 | 3.6 |
| AD-1412683.1 | 20.2 | 4.1 |

TABLE 4-continued

Coagulation Factor V Single Dose Screens in Hep3b cells

| Duplex Name | % mRNA FV/GAPDH | Std Dev. |
|---|---|---|
| AD-1412622.1 | 29.9 | 5.5 |
| AD-1412582.1 | 25.6 | 5.2 |
| AD-1412539.1 | 28.2 | 4.8 |
| AD-111483.1 | 18.5 | 2.8 |
| AD-1412497.1 | 25.6 | 3.2 |
| AD-1412482.1 | 22.8 | 3.7 |
| AD-1412429.1 | 21.7 | 4.0 |
| AD-111345.1 | 22.0 | 2.2 |
| AD-111287.1 | 18.9 | 4.2 |
| AD-1412364.1 | 19.2 | 3.9 |
| AD-1412250.1 | 23.5 | 2.0 |
| AD-1412163.1 | 23.4 | 1.4 |
| AD-1412095.1 | 20.5 | 0.7 |
| AD-1412052.1 | 17.3 | 1.7 |
| AD-1412040.1 | 15.4 | 2.8 |
| AD-110844.1 | 19.0 | 2.2 |
| AD-1412021.1 | 20.2 | 4.7 |
| AD-110787.1 | 20.5 | 1.0 |
| AD-1411972.1 | 19.6 | 4.5 |
| AD-1411935.1 | 24.3 | 1.3 |
| AD-1411798.1 | 72.9 | 6.7 |
| AD-110518.1 | 17.7 | 4.3 |
| AD-1411743.1 | 75.4 | 7.7 |
| AD-110370.1 | 20.5 | 1.2 |
| AD-1411657.1 | 39.3 | 3.6 |
| AD-110281.1 | 20.9 | 1.5 |
| AD-1411521.1 | 18.7 | 1.7 |
| AD-1411480.1 | 20.0 | 3.8 |
| AD-110052.1 | 24.4 | 0.7 |
| AD-1411387.1 | 20.1 | 1.4 |
| AD-1411342.1 | 22.0 | 1.3 |
| AD-1411284.1 | 32.5 | 5.8 |
| AD-1411270.1 | 20.5 | 3.6 |
| AD-109799.1 | 16.9 | 1.5 |
| AD-1411226.1 | 19.5 | 3.8 |
| AD-1411138.1 | 18.3 | 1.7 |
| AD-1411107.1 | 13.0 | 1.7 |
| AD-109601.1 | 24.8 | 5.9 |
| AD-1410994.1 | 15.9 | 3.1 |
| AD-1410926.1 | 22.6 | 1.7 |
| AD-1410880.1 | 19.3 | 4.0 |
| AD-1410845.1 | 20.6 | 4.4 |
| AD-1410825.1 | 21.5 | 6.1 |
| AD-1410725.1 | 31.8 | 4.2 |
| AD-1410700.1 | 37.5 | 1.3 |
| AD-1410662.1 | 18.0 | 3.5 |
| AD-1410628.1 | 27.9 | 1.9 |
| AD-1410605.1 | 29.3 | 3.0 |
| AD-1410577.1 | 22.7 | 1.7 |
| AD-1410569.1 | 22.2 | 5.2 |

Example 3. Additional Duplexes Targeting Coagulation Factor V

Human-cynomolgus cross-reactive agents targeting coagulation factor V gene were designed using custom R and Python scripts and synthesized as described above.

Detailed lists of the unmodified complement coagulation factor V sense and antisense strand nucleotide sequences are shown in Tables 5 and 7. Detailed lists of the modified coagulation factor V sense and antisense strand nucleotide sequences are shown in Tables 6 and 8.

Single dose screens of the additional agents were performed by free uptake.

For free uptake, experiments were performed by adding 2.5 μl of siRNA duplexes in PBS per well into a 96 well plate. Complete growth media (47.5 μl) containing about $1.5\times10^4$ primary human hepatocytes were then added to the siRNA. Cells were incubated for 48 hours prior to RNA purification and RT-qPCR. Single dose experiments were performed at 100 nM, 10 nM, and 1 nM final duplex concentration.

Total RNA isolation was performed using DYNABEADS. Briefly, cells were lysed in 10 μl of Lysis/Binding Buffer containing 3 μL of beads per well were mixed for 10 minutes on an electrostatic shaker. The washing steps were automated on a Biotek EL406, using a magnetic plate support. Beads were washed (in 3 μL) once in Buffer A, once in Buffer B, and twice in Buffer E, with aspiration steps in between. Following a final aspiration, complete 12 μL RT mixture was added to each well, as described below.

For cDNA synthesis, a master mix of 1.5 μl 10× Buffer, 0.6 μl 10×dNTPs, 1.5 μl Random primers, 0.75 μl Reverse Transcriptase, 0.75 μl RNase inhibitor and 9.9 μl of $H_2O$ per reaction was added per well. Plates were sealed, agitated for 10 minutes on an electrostatic shaker, and then incubated at 37 degrees C. for 2 hours. Following this, the plates were agitated at 80 degrees C. for 8 minutes.

RT-qPCR was performed as described above and relative fold change was calculated as described above. The results of the single dose screen of the agents in Tables 5 and 6 in primary human hepatocytes are shown in Table 9.

TABLE 5

| Unmodified Sense and Antisense Strand Sequences of Coagulation Factor V dsRNA Agents | | | | | | |
|---|---|---|---|---|---|---|
| Duplex Name | Sense Sequence 5′ to 3′ | SEQ ID NO: | Range in NM_ 000130.4 | Antisense Sequence 5′ to 3′ | SEQ ID NO: | Range in NM_ 000130.4 |
| AD-1465901.1 | CAGCUAAGGCAGUUCUACGUU | 695 | 233-253 | AACGUAGAACUGCCUUAGCUGUG | 951 | 231-253 |
| AD-1465902.1 | AGGGCAUCAGUUGGAGCUACU | 696 | 261-281 | AGUAGCUCCAACUGAUGCCCUGA | 952 | 259-281 |
| AD-1465903.1 | UCUACAGAGAGUAUGAACCAU | 697 | 339-359 | AUGGUUCAUACUCUCUGUAGACA | 953 | 337-359 |

TABLE 5-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1465904.1 | UACAGAGAGU AUGAACCAUA U | 698 | 341-361 | AUAUGGUUCA UACUCUCUGU AGA | 954 | 339-361 |
| AD-1465905.1 | ACAGAGAGUA UGAACCAUAU U | 699 | 342-362 | AAUAUGGUUC AUACUCUCUG UAG | 955 | 340-362 |
| AD-1465906.1 | UUCUUGGGCC UACUUUAUAU U | 700 | 399-419 | AAUAUAAAGU AGGCCCAAGA AGU | 956 | 397-419 |
| AD-1465907.1 | UACUUUAUAU GCUGAAGUCG U | 701 | 409-429 | ACGACUTCAG CAUAUAAAGU AGG | 957 | 407-429 |
| AD-1465908.1 | ACUUUAUAUG CUGAAGUCGG U | 702 | 410-430 | ACCGACUUCA GCAUAUAAAG UAG | 958 | 408-430 |
| AD-1465909.1 | AGUAAAUUAU CAGAAGGUGC U | 703 | 503-523 | AGCACCUUCU GAUAAUUUAC UGU | 959 | 501-523 |
| AD-1465910.1 | AAAUUAUCAG AAGGUGCUUC U | 704 | 506-526 | AGAAGCACCU UCUGAUAAUU UAC | 960 | 504-526 |
| AD-1465911.1 | AUCAGAAGGU GCUUCUUACC U | 705 | 511-531 | AGGUAAGAAG CACCUUCUGA UAA | 961 | 509-531 |
| AD-1465912.1 | UCAGAAGGUG CUUCUUACCU U | 706 | 512-532 | AAGGUAAGAA GCACCUUCUG AUA | 962 | 510-532 |
| AD-1465913.1 | CAGAAGGUGC UUCUUACCUU U | 707 | 513-533 | AAAGGUAAGA AGCACCUUCU GAU | 963 | 511-533 |
| AD-1465914.1 | AUACACCUAU GAAUGGAGUA U | 708 | 586-606 | AUACUCCAUU CAUAGGUGUA UUC | 964 | 584-606 |
| AD-1465915.1 | ACCUAUGAAU GGAGUAUCAG U | 709 | 590-610 | ACUGAUACUC CAUUCAUAGG UGU | 965 | 588-610 |
| AD-1465916.1 | CCUAUGAAUG GAGUAUCAGU U | 710 | 591-611 | AACUGAUACU CCAUUCAUAG GUG | 966 | 589-611 |
| AD-1465917.1 | AUGAAUGGAG UAUCAGUGAG U | 711 | 594-614 | ACUCACUGAU ACUCCAUUCA UAG | 967 | 592-614 |
| AD-1465918.1 | AUGCCUCACA CACAUCUAUU U | 712 | 643-663 | AAAUAGAUGU GUGUGAGGCA UGG | 968 | 641-663 |
| AD-1465919.1 | UGCCUCACAC ACAUCUAUUA U | 713 | 644-664 | AUAAUAGAUG UGUGUGAGGC AUG | 969 | 642-664 |
| AD-1465920.1 | GCCUCACACA CAUCUAUUAC U | 11 | 645-665 | AGUAAUAGAU GUGUGUGAGG CAU | 12 | 643-665 |
| AD-1465921.1 | CCUCACACAC AUCUAUUACU U | 714 | 646-666 | AAGUAAUAGA UGUGUGUGAG GCA | 970 | 644-666 |

TABLE 5-continued

Unmodified Sense and Antisense Strand Sequences
of Coagulation Factor V dsRNA Agents

| Duplex Name | Sense Sequence 5' to 3' | SEQ ID NO: | Range in NM_ 000130.4 | Antisense Sequence 5' to 3' | SEQ ID NO: | Range in NM_ 000130.4 |
|---|---|---|---|---|---|---|
| AD-1465922.1 | CUCACACACA UCUAUUACUC U | 13 | 647-667 | AGAGTAAUAG AUGUGUGUGA GGC | 14 | 645-667 |
| AD-1465923.1 | CACACACAUC UAUUACUCCC U | 715 | 649-669 | AGGGAGUAAU AGAUGUGUGU GAG | 971 | 647-669 |
| AD-1465924.1 | ACAUCUAUUA CUCCCAUGAA U | 716 | 654-674 | AUUCAUGGGA GUAAUAGAUG UGU | 972 | 652-674 |
| AD-1465925.1 | GAAGACGUUU GACAAGCAAA U | 717 | 757-777 | AUUUGCUUGU CAAACGUCUU CUG | 973 | 755-777 |
| AD-1465926.1 | AGACGUUUGA CAAGCAAAUC U | 718 | 759-779 | AGAUUGCUU GUCAAACGUC UUC | 974 | 757-779 |
| AD-1465927.1 | GACGUUUGAC AAGCAAAUCG U | 719 | 760-780 | ACGAUUUGCU UGUCAAACGU CUU | 975 | 758-780 |
| AD-1465928.1 | GCCAGUCAUC AUCCCUAAUG U | 720 | 819-839 | ACAUUAGGGA UGAUGACUGG CUC | 976 | 817-839 |
| AD-1465929.1 | GUCAUCAUCC CUAAUGUACA U | 721 | 823-843 | AUGUACAUUA GGGAUGAUGA CUG | 977 | 821-843 |
| AD-1465930.1 | CAUCAUCCCU AAUGUACACA U | 722 | 825-845 | AUGUGUACAU UAGGGAUGAU GAC | 978 | 823-845 |
| AD-1465931.1 | AUCAUCCCUA AUGUACACAG U | 723 | 826-846 | ACUGUGUACA UUAGGGAUGA UGA | 979 | 824-846 |
| AD-1465932.1 | AAUGUACACA GUCAAUGGAU U | 724 | 835-855 | AAUCCAUUGA CUGUGUACAU UAG | 980 | 833-855 |
| AD-1465933.1 | AUGUACACAG UCAAUGGAUA U | 725 | 836-856 | AUAUCCAUUG ACUGUGUACA UUA | 981 | 834-856 |
| AD-1465934.1 | AUGUGAAUGG GACAAUGCCA U | 726 | 855-875 | AUGGCAUUGU CCCAUUCACA UAU | 982 | 853-875 |
| AD-1465935.1 | GCCAGAUAUA ACAGUUUGUG U | 727 | 871-891 | ACACAAACUG UUAUAUCUGG CAU | 983 | 869-891 |
| AD-1465936.1 | CCAGAUAUAA CAGUUUGUGC U | 728 | 872-892 | AGCACAAACU GUUAUAUCUG GCA | 984 | 870-892 |
| AD-1465937.1 | GAGCAGAACC AUCAUAAGGU U | 729 | 974-994 | AACCUAUGA UGGUUCUGCU CCA | 985 | 972-994 |
| AD-1465938.1 | CAGAACCAUC AUAAGGUCUC U | 730 | 977-997 | AGAGACCUUA UGAUGGUUCU GCU | 986 | 975-997 |
| AD-1465939.1 | AGAACCAUCA UAAGGUCUCA U | 731 | 978-998 | AUGAGACCUU AUGAUGGUUC UGC | 987 | 976-998 |

TABLE 5-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1465940.1 | AUCACCCUUGUCAGUGCUACU | 732 | 1001-1021 | AGUAGCACUGACAAGGGUGAUGG | 988 | 999-1021 |
| AD-1465941.1 | UUGUCAGUGCUACAUCCACUU | 733 | 1008-1028 | AAGUGGAUGUAGCACUGACAAGG | 989 | 1006-1028 |
| AD-1465942.1 | CAUCCACUACCGCAAAUAUGU | 734 | 1020-1040 | ACAUAUUGCGGUAGUGGAUGUA | 990 | 1018-1040 |
| AD-1465943.1 | AAGCUGGGAUGCAGGCUUACU | 735 | 1095-1115 | AGUAAGCCUGCAUCCCAGCUUGC | 991 | 1093-1115 |
| AD-1465944.1 | AGCUGGGAUGCAGGCUUACAU | 736 | 1096-1116 | AUGUAAGCCUGCAUCCCAGCUUG | 992 | 1094-1116 |
| AD-1465945.1 | GCUGGGAUGCAGGCUUACAUU | 737 | 1097-1117 | AAUGTAAGCCUGCAUCCCAGCUU | 993 | 1095-1117 |
| AD-1465946.1 | CUGGGAUGCAGGCUUACAUUU | 738 | 1098-1118 | AAAUGUAAGCCTGCAUCCCAGCU | 994 | 1096-1118 |
| AD-1465947.1 | UGGGAUGCAGGCUUACAUUGU | 739 | 1099-1119 | ACAATGTAAGCCUGCAUCCCAGC | 995 | 1097-1119 |
| AD-1465948.1 | GGGAUGCAGGCUUACAUUGAU | 740 | 1100-1120 | AUCAAUGUAAGCCUGCAUCCCAG | 996 | 1098-1120 |
| AD-1465949.1 | GGAUGCAGGCUUACAUUGACU | 741 | 1101-1121 | AGUCAATGUAAGCCUGCAUCCCA | 997 | 1099-1121 |
| AD-1465950.1 | GAUGCAGGCUUACAUUGACAU | 742 | 1102-1122 | AUGUCAAUGUAAGCCUGCAUCCC | 998 | 1100-1122 |
| AD-1465951.1 | AUGCAGGCUUACAUUGACAUU | 743 | 1103-1123 | AAUGTCAAUGUAAGCCUGCAUCC | 999 | 1101-1123 |
| AD-1465952.1 | UGCAGGCUUACAUUGACAUUU | 744 | 1104-1124 | AAAUGUCAAUGUAAGCCUGCAUC | 1000 | 1102-1124 |
| AD-1465953.1 | GCAGGCUUACAUUGACAUUAU | 745 | 1105-1125 | AUAATGTCAAUGUAAGCCUGCAU | 1001 | 1103-1125 |
| AD-1465954.1 | CAGGCUUACAUUGACAUUAAU | 71 | 1106-1126 | AUUAAUGUCAAUGUAAGCCUGCA | 202 | 1104-1126 |
| AD-1465955.1 | AGGCUUACAUUGACAUUAAAU | 746 | 1107-1127 | ATUAATGUCAAUGUAAGCCUGC | 1002 | 1105-1127 |
| AD-1465956.1 | GGCUUACAUUGACAUUAAAAU | 747 | 1108-1128 | ATUUAAUGUCAAUGUAAGCCUG | 1003 | 1106-1128 |
| AD-1465957.1 | GCUUACAUUGACAUUAAAAAU | 748 | 1109-1129 | ATUUUAAUGUCAAUGUAAGCCU | 1004 | 1107-1129 |

TABLE 5-continued

Unmodified Sense and Antisense Strand Sequences of Coagulation Factor V dsRNA Agents

| Duplex Name | Sense Sequence 5' to 3' | SEQ ID NO: | Range in NM_ 000130.4 | Antisense Sequence 5' to 3' | SEQ ID NO: | Range in NM_ 000130.4 |
|---|---|---|---|---|---|---|
| AD-1465958.1 | CUUACAUUGA CAUUAAAAAC U | 749 | 1110-1130 | AGUUUTUAAU GUCAAUGUAA GCC | 1005 | 1108-1130 |
| AD-1465959.1 | UUACAUUGAC AUUAAAAACU U | 750 | 1111-1131 | AAGUTUTUAA UGUCAAUGUA AGC | 1006 | 1109-1131 |
| AD-1465960.1 | UACAUUGACA UUAAAAACUG U | 751 | 1112-1132 | ACAGTUTUUA AUGUCAAUGU AAG | 1007 | 1110-1132 |
| AD-1465961.1 | ACAUUGACAU UAAAAACUGC U | 752 | 1113-1133 | AGCAGUTUUU AAUGUCAAUG UAA | 1008 | 1111-1133 |
| AD-1465962.1 | CAUUGACAUU AAAAACUGCC U | 753 | 1114-1134 | AGGCAGUUUU UAAUGUCAAU GUA | 1009 | 1112-1134 |
| AD-1465963.1 | AUUGACAUUA AAAACUGCCC U | 754 | 1115-1135 | AGGGCAGUUU UUAAUGUCAA UGU | 1010 | 1113-1135 |
| AD-1465964.1 | UUGACAUUAA AAACUGCCCA U | 755 | 1116-1136 | AUGGGCAGUU UUUAAUGUCA AUG | 1011 | 1114-1136 |
| AD-1465965.1 | GGGAAUACUU CAUUGCUGCA U | 756 | 1194-1214 | AUGCAGCAAU GAAGUAUUCC CAC | 1012 | 1192-1214 |
| AD-1465966.1 | AGUCAUUUGG GACUAUGCAC U | 757 | 1219-1239 | AGUGCAUAGU CCCAAAUGAC UUC | 1013 | 1217-1239 |
| AD-1465967.1 | GGGACUAUGC ACCUGUAAUA U | 758 | 1227-1247 | AUAUUACAGG UGCAUAGUCC CAA | 1014 | 1225-1247 |
| AD-1465968.1 | CACCUGUAAU ACCAGCGAAU U | 759 | 1236-1256 | AAUUCGCUGG UAUUACAGGU GCA | 1015 | 1234-1256 |
| AD-1465969.1 | UGUAAUACCA GCGAAUAUGG U | 760 | 1240-1260 | ACCAUAUCG CUGGUAUUAC AGG | 1016 | 1238-1260 |
| AD-1465970.1 | GUAAUACCAG CGAAUAUGGA U | 761 | 1241-1261 | AUCCAUAUUC GCUGGUAUUA CAG | 1017 | 1239-1261 |
| AD-1465971.1 | AGGUCUCAGC AUUUGGAUAA U | 762 | 1271-1291 | AUUAUCCAAA UGCUGAGACC UGU | 1018 | 1269-1291 |
| AD-1465972.1 | GUUAUGUACA CACAGUACGA U | 763 | 1325-1345 | AUCGUACUGU GUGUACAUAA CUU | 1019 | 1323-1345 |
| AD-1465973.1 | UUAUGUACAC ACAGUACGAA U | 764 | 1326-1346 | AUUCGUACUG UGUGUACAUA ACU | 1020 | 1324-1346 |
| AD-1465974.1 | AUGUACACAC AGUACGAAGA U | 765 | 1328-1348 | AUCUUCGUAC UGUGUGUACA UAA | 1021 | 1326-1348 |
| AD-1465975.1 | UGUACACACA GUACGAAGAU U | 766 | 1329-1349 | AAUCUUCGUA CUGUGUGUAC AUA | 1022 | 1327-1349 |

TABLE 5-continued

Unmodified Sense and Antisense Strand Sequences of Coagulation Factor V dsRNA Agents

| Duplex

TABLE 5-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1465994.1 | UGAGCACUAUCAAUGGCUAUU | 785 | 1902-1922 | AAUAGCCAUUGAUAGUGCUCAUG | 1041 | 1900-1922 |
| AD-1465996.1 | GAUUCUGCUUUGAUGACACUU | 786 | 1947-1967 | AAGUGUCAUCAAAGCAGAAUCCA | 1042 | 1945-1967 |
| AD-1465997.1 | CCAGUGGCACUUCUGUAGUGU | 787 | 1969-1989 | ACACUACAGAAGUGCCACUGGAC | 1043 | 1967-1989 |
| AD-1465998.1 | AGUGGCACUUCUGUAGUGUGU | 788 | 1971-1991 | ACACACUACAGAAGUGCCACUGG | 1044 | 1969-1991 |
| AD-1465999.1 | CUGGGCACUCAUUCAUCUAUU | 789 | 2025-2045 | AAUAGAUGAAUGAGUGCCCAGUG | 1045 | 2023-2045 |
| AD-1466000.1 | GUGACGGUCACAAUGGAUAAU | 790 | 2096-2116 | AUUAUCCAUUGUGACCGUCACAG | 1046 | 2094-2116 |
| AD-1466001.1 | GGAACUUGGAUGUUAACUUCU | 791 | 2120-2140 | AGAAGUUAACAUCCAAGUUCCAA | 1047 | 2118-2140 |
| AD-1466002.1 | UUAACUUCCAUGAAUUCUAGU | 792 | 2132-2152 | ACUAGAAUUCAUGGAAGUUAACA | 1048 | 2130-2152 |
| AD-1466003.1 | AUGAUGAUGAAGACUCAUAUU | 793 | 2205-2225 | AAUAUGAGUCUUCAUCAUCAUCU | 1049 | 2203-2225 |
| AD-1466004.1 | UGAUGAAGACUCAUAUGAGAU | 794 | 2209-2229 | AUCUCAUAUGAGUCUUCAUCAUC | 1050 | 2207-2229 |
| AD-1466005.1 | AAACUCAUCAUUGAAUCAGGU | 795 | 2365-2385 | ACCUGAUUCAAUGAUGAGUUUCG | 1051 | 2363-2385 |
| AD-1466006.1 | AAACACAGAUAAUAAUUGUUGU | 796 | 2446-2466 | ACAACAAUUAUAUCUGUGUUUGA | 1052 | 2444-2466 |
| AD-1466007.1 | CACAGAUAUAAUUGUUGGUUU | 797 | 2449-2469 | AAACCAACAAUUAUAUCUGUGUU | 1053 | 2447-2469 |
| AD-1466008.1 | CAUAUUCUGAAGACCCUAUAU | 798 | 2634-2654 | AUAUAGGGUCUUCAGAAUAUGGG | 1054 | 2632-2654 |
| AD-1466009.1 | AUUCUGAAGACCCUAUAGAGU | 799 | 2637-2657 | ACUCUAUAGGGUCUUCAGAAUAU | 1055 | 2635-2657 |
| AD-1466010.1 | CGUCUACUUUCACUUGGUGCU | 800 | 2687-2707 | AGCACCAAGUGAAAGUAGACGUA | 1056 | 2685-2707 |
| AD-1466011.1 | AUGAAAUUACUAGCACAUAAU | 801 | 2792-2812 | AUUAUGUGCUAGUAAUUUCAUCC | 1057 | 2790-2812 |
| AD-1466012.1 | AAUUACUAGCACAUAAAGUUU | 802 | 2796-2816 | AAACUUUAUGUGCUAGUAAUUUC | 1058 | 2794-2816 |

TABLE 5-continued

Unmodified Sense and Antisense Strand Sequences of Coagulation Factor V dsRNA Agents

| Duplex Name | Sense Sequence 5' to 3' | SE

TABLE 5-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1466031.1 | GAGUAUGACCGAAGUCACAAU | 821 | 3617-3637 | AUUGUGACUUCGGUCAUACUCAA | 1077 | 3615-3637 |
| AD-1466032.1 | UAUGACCGAAGUCACAAGUCU | 822 | 3620-3640 | AGACUGUGACUUCGGUCAUACU | 1078 | 3618-3640 |
| AD-1466033.1 | UGACCGAAGUCACAAGUCCUU | 823 | 3622-3642 | AAGGACUGUGACUUCGGUCAUA | 1079 | 3620-3642 |
| AD-1466034.1 | GACCGAAGUCACAAGUCCUUU | 824 | 3623-3643 | AAAGGACUUGUGACUUCGGUCAU | 1080 | 3621-3643 |
| AD-1466035.1 | ACCGAAGUCACAAGUCCUUCU | 825 | 3624-3644 | AGAAGGACUUGUGACUUCGGUCA | 1081 | 3622-3644 |
| AD-1466036.1 | UCUCCAGAACUCAGUCAGACU | 826 | 3920-3940 | AGUCUGACUGAGUUCUGGAGAGA | 1082 | 3918-3940 |
| AD-1466036.2 | UCUCCAGAACUCAGUCAGACU | 826 | 3920-3940 | AGUCUGACUGAGUUCUGGAGAGA | 1082 | 3918-3940 |
| AD-1466036.3 | UCUCCAGAACUCAGUCAGACU | 826 | 3920-3940 | AGUCUGACUGAGUUCUGGAGAGA | 1082 | 3918-3940 |
| AD-1466037.1 | CUCCAGAACUCAGUCAGACAU | 827 | 3921-3941 | AUGUCUGACUGAGUUCUGGAGAG | 1083 | 3919-3941 |
| AD-1466037.2 | CUCCAGAACUCAGUCAGACAU | 827 | 3921-3941 | AUGUCUGACUGAGUUCUGGAGAG | 1083 | 3919-3941 |
| AD-1466037.3 | CUCCAGAACUCAGUCAGACAU | 827 | 3921-3941 | AUGUCUGACUGAGUUCUGGAGAG | 1083 | 3919-3941 |
| AD-1466038.1 | CAGCCAGACAAACCUCUCUCU | 828 | 3742-3762 | AGAGAGAGGUUUGUCUGGCUGAA | 1084 | 3740-3762 |
| AD-1466038.2 | CAGCCAGACAAACCUCUCUCU | 828 | 3742-3762 | AGAGAGAGGUUUGUCUGGCUGAA | 1084 | 3740-3762 |
| AD-1466039.1 | UUCUACCCUUCUGAAUCUAGU | 829 | 4535-4555 | ACUAGAUUCAGAAGGGUAGAAUA | 1085 | 4533-4555 |
| AD-1466040.1 | CAUCUCCUACUCUCAAUGAUU | 830 | 4626-4646 | AAUCAUUGAGAGUAGGAGAUGAA | 1086 | 4624-4646 |
| AD-1466041.1 | AUCAAAGGAAUUUAAUCCACU | 831 | 4654-4674 | AGUGGAUUAAAUUCCUUUGAUAG | 1087 | 4652-4674 |
| AD-1466042.1 | AAGGAAUUUAAUCCACUGGUU | 832 | 4658-4678 | AACCAGUGGAUUAAAUUCCUUUG | 1088 | 4656-4678 |
| AD-1466043.1 | UUUAAUCCACUGGUUAUAGUU | 833 | 4664-4684 | AACUAUAACCAGUGGAUUAAAUU | 1089 | 4662-4684 |

TABLE 5-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1466044.1 | UUAAUCCACUGGUUAUAGUGU | 834 | 4665-4685 | ACACTATAACCAGUGGAUUAAAU | 1090 | 4663-4685 |
| AD-1466045.1 | AGAUGGUACAGAUUACAUUGU | 835 | 4696-4716 | ACAATGTAAUCUGUACCAUCUUU | 1091 | 4694-4716 |
| AD-1466046.1 | AUGGUACAGAUUACAUUGAGU | 836 | 4698-4718 | ACUCAATGUAATCUGUACCAUCU | 1092 | 4696-4718 |
| AD-1466047.1 | ACUGAUGUUAGGACAAACAUU | 837 | 4799-4819 | AAUGTUTGUCCTAACAUCAGUUU | 1093 | 4797-4819 |
| AD-1466048.1 | CUGAUGUUAGGACAAACAUCU | 838 | 4800-4820 | AGAUGUTUGUCCUAACAUCAGUU | 1094 | 4798-4820 |
| AD-1466049.1 | GAAGAAAUAUCCUGGGAUUAU | 839 | 4904-4924 | AUAATCCCAGGAUAUUUCUUCAG | 1095 | 4902-4924 |
| AD-1466050.1 | UGAAGACUCUGAUGAUAUUCU | 840 | 4954-4974 | AGAATATCAUCAGAGUCUUCAAU | 1096 | 4952-4974 |
| AD-1466051.1 | GUAUGAAGAGCAUCUCGGAAU | 841 | 5053-5073 | ATUCCGAGAUGCUCUUCAUACUC | 1097 | 5051-5073 |
| AD-1466052.1 | AGAGCAUCUCGGAAUUCUUGU | 842 | 5059-5079 | ACAAGAAUUCCGAGAUGCUCUUC | 1098 | 5057-5079 |
| AD-1466053.1 | UCGGAAUUCUUGGUCCUAUUU | 113 | 5067-5087 | AAAUAGGACCAAGAAUUCCGAGA | 244 | 5065-5087 |
| AD-1466054.1 | CGGAAUUCUUGGUCCUAUUAU | 843 | 5068-5088 | AUAATAGGACCAAGAAUUCCGAG | 1099 | 5066-5088 |
| AD-1466055.1 | AAUUCUUGGUCCUAUUAUCAU | 844 | 5071-5091 | ATGATAAUAGGACCAAGAAUUCC | 1100 | 5069-5091 |
| AD-1466056.1 | UCUUGGUCCUAUUAUCAGAGU | 845 | 5074-5094 | ACUCTGAUAAUAGGACCAAGAAU | 1101 | 5072-5094 |
| AD-1466057.1 | GUCCUAUUAUCAGAGCUGAAU | 846 | 5079-5099 | AUUCAGCUCUGAUAAUAGGACCA | 1102 | 5077-5099 |
| AD-1466058.1 | UGAAGUGGAUGAUGUUAUCCU | 847 | 5095-5115 | AGGATAACAUCAUCCACUUCAGC | 1103 | 5093-5115 |
| AD-1466059.1 | GAAGUGGAUGAUGUUAUCCAU | 848 | 5096-5116 | ATGGAUAACAUCAUCCACUUCAG | 1104 | 5094-5116 |
| AD-1466060.1 | AUCAGAGGGAAAGACUUAUGU | 849 | 5185-5205 | ACAUAAGUCUUTCCCUCUGAUGA | 1105 | 5183-5205 |
| AD-1466061.1 | AGGGAAAGACUUAUGAAGAUU | 850 | 5190-5210 | AAUCUCAUAAGUCUUUCCCUCU | 1106 | 5188-5210 |

TABLE 5-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1466062.1 | AGCCAAAUAGCAGUUAUACCU | 851 | 5247-5267 | AGGUAUAACUGCUAUUUGGCUGA | 1107 | 5245-5267 |
| AD-1466063.1 | AGCAGUUAUACCUACGUAUGU | 852 | 5255-5275 | ACAUACGUAGGTAUAACUGCUAU | 1108 | 5253-5275 |
| AD-1466064.1 | GAUAUUCACUCAGGCUUGAUU | 853 | 5360-5380 | AAUCAAGCCUGAGUGAAUAUCUU | 1109 | 5358-5380 |
| AD-1466065.1 | GGAAUACUACAUAAGGACAGU | 854 | 5405-5425 | ACUGUCCUUAUGUAGUAUUCCUU | 1110 | 5403-5425 |
| AD-1466066.1 | CUACAUAAGGACAGCAACAUU | 855 | 5411-5431 | AAUGUUGCUGUCCUUAUGUAGUA | 1111 | 5409-5431 |
| AD-1466067.1 | ACAUAAGGACAGCAACAUGCU | 856 | 5413-5433 | AGCAUGUUGCUGUCCUUAUGUAG | 1112 | 5411-5433 |
| AD-1466068.1 | ACAUGAGAGAAUUUGUCUUAU | 857 | 5439-5459 | AUAAGACAAAUUCUCUCAUGUCC | 1113 | 5437-5459 |
| AD-1466069.1 | CAUGAGAGAAUUUGUCUUACU | 858 | 5440-5460 | AGUAAGACAAAUUCUCUCAUGUC | 1114 | 5438-5460 |
| AD-1466070.1 | GAGAGAAUUUGUCUUACUAUU | 46 | 5443-5463 | AAUAGUAAGACAAAUUCUCUCAU | 177 | 5441-5463 |
| AD-1466071.1 | GACCUUUGAUGAAAGAAGAU | 859 | 5467-5487 | AUCUUCUUUCAUCAAAGGUCAU | 1115 | 5465-5487 |
| AD-1466072.1 | ACCUUUGAUGAAAAGAAGAGU | 860 | 5468-5488 | ACUCUUCUUUUCAUCAAAGGUCA | 1116 | 5466-5488 |
| AD-1466073.1 | CCUUUGAUGAAAAGAAGAGCU | 861 | 5469-5489 | AGCUCUUCUUUUCAUCAAAGGUC | 1117 | 5467-5489 |
| AD-1466074.1 | CUUUGAUGAAAAGAAGAGCUU | 862 | 5470-5490 | AAGCUCUUCUUUUCAUCAAAGGU | 1118 | 5468-5490 |
| AD-1466075.1 | UUUGAUGAAAAGAAGAGCUGU | 863 | 5471-5491 | ACAGCUCUUCUUUUCAUCAAAGG | 1119 | 5469-5491 |
| AD-1466076.1 | UUGAUGAAAAGAAGAGCUGGU | 864 | 5472-5492 | ACCAGCUCUUCUUUUCAUCAAAG | 1120 | 5470-5492 |
| AD-1466077.1 | UGAUGAAAAGAAGAGCUGGUU | 865 | 5473-5493 | AACCAGCUCUUCUUUUCAUCAAA | 1121 | 5471-5493 |
| AD-1466078.1 | GAUGAAAAGAAGAGCUGGUAU | 866 | 5474-5494 | AUACCAGCUCUUCUUUUCAUCAA | 1122 | 5472-5494 |
| AD-1466079.1 | AUGAAAAGAAGAGCUGGUACU | 867 | 5475-5495 | AGUACCAGCUCUUCUUUUCAUCA | 1123 | 5473-5495 |

TABLE 5-continued

Unmodified Sense and Antisense Strand Sequences
of Coagulation Factor V dsRNA Agents

| Duplex Name | Sense Sequence 5' to 3' | SEQ ID NO: | Range in NM_ 000130.4 | Antisense Sequence 5' to 3' | SEQ ID NO: | Range in NM_ 000130.4 |
|---|---|---|---|---|---|---|
| AD-1466080.1 | UGAAAAGAAGAGCUGGUACUU | 868 | 5476-5496 | AAGUACCAGCUCUUCUUUUCAUC | 1124 | 5474-5496 |
| AD-1466081.1 | GAAAAGAAGAGCUGGUACUAU | 869 | 5477-5497 | ATAGTACCAGCTCUUCUUUUCAU | 1125 | 5475-5497 |
| AD-1466082.1 | AAAAGAAGAGCUGGUACUAUU | 870 | 5478-5498 | AAUAGUACCAGCUCUUCUUUUCA | 1126 | 5476-5498 |
| AD-1466083.1 | AAAGAAGAGCUGGUACUAUGU | 871 | 5479-5499 | ACAUAGUACCAGCUCUUCUUUUC | 1127 | 5477-5499 |
| AD-1466084.1 | AAGAAGAGCUGGUACUAUGAU | 872 | 5480-5500 | AUCAUAGUACCAGCUCUUCUUUU | 1128 | 5478-5500 |
| AD-1466085.1 | AGAAGAGCUGGUACUAUGAAU | 873 | 5481-5501 | ATUCAUAGUACCAGCUCUUCUUU | 1129 | 5479-5501 |
| AD-1466086.1 | GAAGAGCUGGUACUAUGAAAU | 874 | 5482-5502 | AUUUCAUAGUACCAGCUCUUCUU | 1130 | 5480-5502 |
| AD-1466087.1 | AAGAGCUGGUACUAUGAAAAU | 875 | 5483-5503 | AUUUUCAUAGUACCAGCUCUUCU | 1131 | 5481-5503 |
| AD-1466088.1 | AGAGCUGGUACUAUGAAAAGU | 876 | 5484-5504 | ACUUUUCAUAGUACCAGCUCUUC | 1132 | 5482-5504 |
| AD-1466089.1 | GAGCUGGUACUAUGAAAAGAU | 877 | 5485-5505 | ATCUUUUCAUAGUACCAGCUCUU | 1133 | 5483-5505 |
| AD-1466090.1 | AGCUGGUACUAUGAAAAGAAU | 878 | 5486-5506 | AUUCUUUUCAUAGUACCAGCUCU | 1134 | 5484-5506 |
| AD-1466091.1 | GCUGGUACUAUGAAAAGAAGU | 879 | 5487-5507 | ACUUCUUUUCAUAGUACCAGCUC | 1135 | 5485-5507 |
| AD-1466092.1 | CUGGUACUAUGAAAAGAAGUU | 880 | 5488-5508 | AACUUCUUUUCAUAGUACCAGCU | 1136 | 5486-5508 |
| AD-1466093.1 | CCGAAGUUCUUGGAGACUCAU | 881 | 5509-5529 | AUGAGUCUCCAAGAACUUCGGGA | 1137 | 5507-5529 |
| AD-1466094.1 | GAAGUUCUUGGAGACUCACAU | 882 | 5511-5531 | AUGUGAGUCUCCAAGAACUUCGG | 1138 | 5509-5531 |
| AD-1466095.1 | UUUCACGCCAUUAAUGGGAUU | 883 | 5558-5578 | AAUCCCAUUAAUGGCGUGAAACU | 1139 | 5556-5578 |
| AD-1466096.1 | AUUAAUGGGAUGAUCUACAGU | 884 | 5567-5587 | ACUGUAGAUCAUCCCAUUAAUGG | 1140 | 5565-5587 |
| AD-1466097.1 | GCUCCCAAGACAUUCACGUGU | 885 | 5649-5669 | ACACGUGAAUGUCUUGGGAGCCG | 1141 | 5647-5669 |

TABLE 5-continued

Unmodified Sense and Antisense Strand Sequences of Coagulation Factor V dsRNA Agents

| Duplex Name | Sense Sequence 5' to 3' | SEQ ID NO: | Range in NM_ 000130.4 | Antisense Sequence 5' to 3' | SEQ ID NO: | Range in NM_ 000130.4 |
|---|---|---|---|---|---|---|
| AD-1466098.1 | CCAAGACAUUCACGUGGUUCU | 886 | 5653-5673 | AGAACCACGUGAAUGUCUUGGGA | 1142 | 5651-5673 |
| AD-1466099.1 | AUUCACGUGGUUCACUUUCAU | 887 | 5660-5680 | AUGAAAGUGAACCACGUGAAUGU | 1143 | 5658-5680 |
| AD-1466100.1 | AUGCAAACGCCAUUUCUUAUU | 888 | 5831-5851 | AAUAAGAAAUGGCGUUUGCAUCC | 1144 | 5829-5851 |
| AD-1466101.1 | GCAAACGCCAUUUCUUAUCAU | 889 | 5833-5853 | ATGATAAGAAATGGCGUUUGCAU | 1145 | 5831-5853 |
| AD-1466102.1 | UCUUAUCAUGGACAGAGACUU | 890 | 5845-5865 | AAGUCUCUGUCCAUGAUAAGAAA | 1146 | 5843-5865 |
| AD-1466103.1 | UUAUCAUGGACAGAGACUGUU | 891 | 5847-5867 | AACAGUCUCUGUCCAUGAUAAGA | 1147 | 5845-5867 |
| AD-1466104.1 | UAAGCACUGGUAUCAUAUCUU | 892 | 5883-5903 | AAGATATGAUACCAGUGCUUAGU | 1148 | 5881-5903 |
| AD-1466105.1 | UCAUAUCUGAUUCACAGAUCU | 893 | 5895-5915 | AGAUCUGUGAAUCAGAUAUGAUA | 1149 | 5893-5915 |
| AD-1466106.1 | AUAUCUGAUUCACAGAUCAAU | 118 | 5897-5917 | AUUGAUCUGUGAAUCAGAUAUGA | 249 | 5895-5917 |
| AD-1466107.1 | UAAACAAUGGUGGAUCUUAUU | 894 | 5961-5981 | AAUAAGAUCCACCAUUGUUUAAU | 1150 | 5959-5981 |
| AD-1466108.1 | AAACAAUGGUGGAUCUUAUAU | 895 | 5962-5982 | ATAUAAGAUCCACCAUUGUUUAA | 1151 | 5960-5982 |
| AD-1466109.1 | CAAUGGUGGAUCUUAUAAUGU | 896 | 5965-5985 | ACAUTATAAGATCCACCAUUGUU | 1152 | 5963-5985 |
| AD-1466110.1 | GGUGGAUCUUAUAAUGCUUGU | 897 | 5969-5989 | ACAAGCAUUAUAAGAUCCACCAU | 1153 | 5967-5989 |
| AD-1466111.1 | AUCUUAUAAUGCUUGGAGUGU | 898 | 5974-5994 | ACACTCCAAGCAUUAUAAGAUCC | 1154 | 5972-5994 |
| AD-1466112.1 | CAAGGUGCCAAACACUACCUU | 899 | 6080-6100 | AAGGTAGUGUUUGGCACCUUGGG | 1155 | 6078-6100 |
| AD-1466113.1 | CCUGCUAUACCACAGAGUUCU | 900 | 6105-6125 | AGAACUCUGGGUAUAGCAGGAC | 1156 | 6103-6125 |
| AD-1466114.1 | CUGCUAUACCACAGAGUUCUU | 19 | 6106-6126 | AAGAACUCUGUGGUAUAGCAGGA | 20 | 6104-6126 |
| AD-1466115.1 | UAUACCACAGAGUUCUAUGUU | 901 | 6110-6130 | AACATAGAACUCUGUGGUAUAGC | 1157 | 6108-6130 |

TABLE 5-continued

Unmodified Sense and Antisense Strand Sequences
of Coagulation Factor V dsRNA Agents

| Duplex Name | Sense Sequence 5' to 3'

TABLE 5-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1466134.1 | AUUGAUCUACUCAAGAUCAAU | 125 | 6518-6538 | AUUGAUCUUGAGUAGAUCAAUUU | 256 | 6516-6538 |
| AD-1466135.1 | AAAUGUAUGUAAAGAGCUAUU | 920 | 6585-6605 | AAUAGCTCUUUACAUACAUUUCA | 1176 | 6583-6605 |
| AD-1466136.1 | AUGUAAAGAGCUAUACCAUCU | 921 | 6591-6611 | AGAUGGTAUAGCUCUUUACAUAC | 1177 | 6589-6611 |
| AD-1466137.1 | AAGAGCUAUACCAUCCACUAU | 922 | 6596-6616 | AUAGTGGAUGGUAUAGCUCUUUA | 1178 | 6594-6616 |
| AD-1466138.1 | CUCCAUGGUGGACAAGAUUUU | 923 | 6658-6678 | AAAATCTUGUCCACCAUGGAGGA | 1179 | 6656-6678 |
| AD-1466139.1 | UCCAUGGUGGACAAGAUUUUU | 924 | 6659-6679 | AAAAAUCUUGUCCACCAUGGAGG | 1180 | 6657-6679 |
| AD-1466140.1 | CCAUGGUGGACAAGAUUUUUU | 925 | 6660-6680 | AAAAAATCUUGTCCACCAUGGAG | 1181 | 6658-6680 |
| AD-1466141.1 | CAUGGUGGACAAGAUUUUUGU | 926 | 6661-6681 | ACAAAAAUCUUGUCCACCAUGGA | 1182 | 6659-6681 |
| AD-1466142.1 | AUGGUGGACAAGAUUUUUGAU | 927 | 6662-6682 | ATCAAAAAUCUUGUCCACCAUGG | 1183 | 6660-6682 |
| AD-1466143.1 | UGGUGGACAAGAUUUUUGAAU | 928 | 6663-6683 | ATUCAAAAAUCUUGUCCACCAUG | 1184 | 6661-6683 |
| AD-1466144.1 | GGUGGACAAGAUUUUUGAAGU | 929 | 6664-6684 | ACUUCAAAAAUCUUGUCCACCAU | 1185 | 6662-6684 |
| AD-1466145.1 | GUGGACAAGAUUUUUGAAGGU | 930 | 6665-6685 | ACCUTCAAAAAUCUUGUCCACCA | 1186 | 6663-6685 |
| AD-1466146.1 | UGGACAAGAUUUUUGAAGGAU | 931 | 6666-6686 | AUCCUUCAAAAAUCUUGUCCACC | 1187 | 6664-6686 |
| AD-1466147.1 | GGACAAGAUUUUUGAAGGAAU | 932 | 6667-6687 | AUUCCUTCAAAAAUCUUGUCCAC | 1188 | 6665-6687 |
| AD-1466148.1 | GACAAGAUUUUUGAAGGAAAU | 933 | 6668-6688 | AUUUCCUUCAAAAAUCUUGUCCA | 1189 | 6666-6688 |
| AD-1466149.1 | ACAAGAUUUUUGAAGGAAAUU | 934 | 6669-6689 | AAUUTCCUUCAAAAAUCUUGUCC | 1190 | 6667-6689 |
| AD-1466150.1 | CAAGAUUUUUGAAGGAAAUAU | 935 | 6670-6690 | AUAUUCCUUCAAAAAUCUUGUC | 1191 | 6668-6690 |
| AD-1466151.1 | AAGAUUUUUGAAGGAAAUACU | 936 | 6671-6691 | AGUAUCCUUCAAAAAUCUUGU | 1192 | 6669-6691 |

TABLE 5-continued

Unmodified Sense and Antisense Strand Sequences
of Coagulation Factor V dsRNA Agents

| Duplex Name | Sense Sequence 5' to 3' | SEQ

TABLE 6

Modified Sense and Antisense Strand Sequences of Coagulation Factor V dsRNA Ag

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1465916.1 | cscsuaugaaUfGfGfaguaucaguuL96 | 1222 | asdAscudGadTacucdCaUfucauaggsusg | 1482 | CACCUUGAAUGGAGUAUCAGUG | 1746 |
| AD-1465917.1 | asusgaauggAfGfUfaucagugaguL96 | 1223 | asdCsucdAcdTgauadCuUfcauucausasg | 1483 | CUAUGAAUGGAGAUCAGUGAG | 1747 |
| AD-1465918.1 | asusgcccucaCfAfCfcacucauuuuL96 | 1224 | asdAsaudAgdAugugdTgUfgaggcausgg | 1484 | CCAUGCCUCACACACAUCUAUUA | 1748 |
| AD-1465919.1 | usgscccucaCfAfCfAfcaucuauuauL96 | 1225 | asdTsaadTadGaugudGuGfugaggcasusg | 1485 | CAUGCCUCACACACAUCUAUUAC | 1749 |
| AD-1465920.1 | gcscsucacaCfAfCfaucuauuacuuL96 | 1226 | asdGsuadAudAgaugdTgUfgugaggcsasu | 1486 | AUGCCUCACACACAUCUAUUACU | 1750 |
| AD-1465921.1 | cscsucacaCfAfCfAfucuauuacuuL96 | 1227 | asdAsgudAAdTagaudGuUfuguaggscsa | 1487 | UGCCUCACACACAUCUAUUACUC | 1751 |
| AD-1465922.1 | csuscacacaCfAfUfcuauuacucuL96 | 1228 | asdGsagdTadAuagadTgUfgugugagsgsc | 1488 | GCCUCACACACAUCUAUUACUCC | 1752 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1465932.1 | asasuguacaCfAfGfucaauggauuL96 | 1238 | asdAsucdCadTugacdTgTfguacauusasg | 1498 | CUAAUGUACACAGUCAAUGGAUA | 1762 |
| AD-1465933.1 | asusguacAfcAfGfUfcaauggauauL96 | 1239 | asUfsaudCc(Agn)uugacuGfuGfuacaususa | 1499 | UAAUGUACACAGUCAAUGAUAU | 1763 |
| AD-1465934.1 | asusgugaAfuGfGfGfacaaugccauL96 | 1240 | asUfsggdCa(Tgn)ugucccAfuUfcacausasu | 1500 | AUAUGUGAUGGGACAAUGCCAG | 1764 |
| AD-1465935.1 | gscscagauaUfAfAfcaguuugugucuL96 | 1241 | asdCsacdAadAcugudTaTfaucuggcsasu | 1501 | AUGCCAGAUAUAACAGUUUGUGC | 1765 |
| AD-1465936.1 | cscscagauauAfAfCfaguuugugucuL96 | 1242 | asdGscadCadAacugdTuAfuaucuggscsa | 1502 | UGCCAGAUAUAACAGUUUGUGCC | 1766 |
| AD-1465937.1 | gsasgcagaaCfCfAfucauaagguuL96 | 1243 | asdAsccdTudAugaudGgUfucugcucscsa | 1503 | UGGAGCAGAACCAUCAUAAGGUC | 1767 |
| AD-1465938.1 | csasgaaCfcfAfUfCfAfAtuaaggucucuL96 | 1244 | asGfsagdAc(C2p)uuaugaUfgGfuucugscsu | 1504 | AGCAGAACCAUCAUAAGGUCUCA | 1768 |
| AD-1465939.1 | asgsaaccAfucfCfAfUfUfaaggucucauL96 | 1245 | asUfsgadGa(C2p)cuuaugAfuGfguucusgsc | 1505 | GCAGAACCAUCAUAAGGUCUCAG | 1769 |
| AD-1465940.1 | asuscaccCfuUfGfUfcagugcuacuL96 | 1246 | asGfsuadGc(Agn)cugacaAfgGfgugausgsg | 1506 | CCAUCACCCUUGUCAGUGCUACA | 1770 |
| AD-1465941.1 | ususugucaGfuGfCfUfacauccacuuL96 | 1247 | asAfsgudGg(Agn)uguagcAfcUfgacaasgsg | 1507 | CCUUGUCAGUGCUACAUCCACUA | 1771 |
| AD-1465942.1 | csasuccacuaAfCfCfgcaaauauguL96 | 1248 | asdCsaudAudTugcgdGuAfguggaugsusa | 1508 | UACAUCCACUACCGCAAAUAUGA | 1772 |
| AD-1465943.1 | asasgcugGfgAfUfGfCfcaggcuuacuL96 | 1249 | asGfsuadAg(C2p)cugcaucfcCfagcuusgsc | 1509 | GCAAGCUGGGAUGCAGGCUUACA | 1773 |
| AD-1465944.1 | agsgscuggGfaAfUfGfcaggcuuacauL96 | 1250 | asUfsgudAa(G2p)ccugcaUfcCfcagcusug | 1510 | CAAGCUGGGAUGCAGGCUUACAU | 1774 |
| AD-1465945.1 | gscssuggauGfcfAfgccuuacauuL96 | 1251 | asdAsugdTadAgccudGcAfuccagesusu | 1511 | AAGCUGGGAUGCAGGCUUACAUU | 1775 |
| AD-1465946.1 | csusgggaugCfAfGfgcuuacauuuL96 | 1252 | asdAsaudGudAagccdTgCfauccagscsu | 1512 | AGCUGGGAUGCAGGCUUACAUUG | 1776 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1465947.1 | usgsggaugcAfGfGfcuuacauuguL96 | 1253 | asdCsaadTgdTaagcdCuGfcaucccasgsc | 1513 | GCUGGGAUGCAGGCUUACAUUGA | 1777 |
| AD-1465948.1 | gsgsgaugCfaGfGfCfuuacauugauL96 | 1254 | asUfscadAu(G2p)uaagccUfgCfaucccsasg | 1514 | CUGGGAUGCAGGCUUACAUUGAC | 1778 |
| AD-1465949.1 | gsgsaugcagGfCfUfuacauugacuL96 | 1255 | asdGsucdAadTguaadGcCfugcaucescsa | 1515 | UGGGAUGCAGGCUUACAUUGACA | 1779 |
| AD-1465950.1 | gsasugcaGfgCfUfUfacauugacauL96 | 1256 | asUfsgudCa(Agn)uguaagCfcUfgcaucscsc | 1516 | GGGAUGCAGGCUUACAUUGACAU | 1780 |
| AD-1465951.1 | asusgcaggcUfUfAfcauugacauuL96 | 1257 | asdAsugdTcdAaugudAaGfccugcauscsc | 1517 | GGAUGCAGGCUUACAUUGACAUU | 1781 |
| AD-1465952.1 | usgscaggCfuUfAfCfauugacauuuL96 | 1258 | asAfsaudGu(C2p)aauguaAfgCfcugcasusc | 1518 | GAUGCAGGCUUACAUUGACAUUA | 1782 |
| AD-1465953.1 | gscsaggcUfuAfCfAfuugacauuauL96 | 1259 | asUfsaadTg(Tgn)caauguAfaGfccugcsasu | 1519 | AUGCAGGCUUACAUUGACAUUAA | 1783 |
| AD-1465954.1 | csasggcuUfaCfAfUfugacauuaauL96 | 335 | asUfsuadAu(G2p)ucaaugUfaAfgccugscsa | 1520 | UGCAGGCUUACAUUGACAUUAAA | 603 |
| AD-1465955.1 | asgsgcuuacAfUfUfgacauuaaauL96 | 1260 | asdTsuudAadTgucadAuGfuaagccusgsc | 1521 | GCAGGCUUACAUUGACAUUAAAA | 1784 |
| AD-1465956.1 | gsgscuuacaUfUfGfacauuaaaauL96 | 1261 | asdTsuudTadAugucdAaUfguaagccsusg | 1522 | CAGGCUUACAUUGACAUUAAAAA | 1785 |
| AD-1465957.1 | gscsuuacauUfGfAfcauuaaaaauL96 | 1262 | asdTsuudTudAaugudCaAfuguaagcscsu | 1523 | AGGCUUACAUUGACAUUAAAAAC | 1786 |
| AD-1465958.1 | csusuacauuGfAfCfauuaaaaacuL96 | 1263 | asdGsuudTudTaaugdTcAfauguaagscsc | 1524 | GGCUUACAUUGACAUUAAAAACU | 1787 |
| AD-1465959.1 | ususacauugAfCfAfuuaaaaacuuL96 | 1264 | asdAsgudTudTuaaudGuCfaauguaasgsc | 1525 | GCUUACAUUGACAUUAAAAACUG | 1788 |
| AD-1465960.1 | usascauugaCfAfUfuaaaaacuguL96 | 1265 | asdCsagdTudTuuaadTgUfcaauguasasg | 1526 | CUUACAUUGACAUUAAAAACUGC | 1789 |
| AD-1465961.1 | ascsauugacAfUfUfaaaaacugcuL96 | 1266 | asdGscadGudTuuuadAuGfucaaugusasa | 1527 | UUACAUUGACAUUAAAAACUGCC | 1790 |
| AD-1465962.1 | csasuugaCfaUfUfAfaaaacugccuL96 | 1267 | asGfsgcdAg(Tgn)uuuuaaUfgUfcaaugsusa | 1528 | UACAUUGACAUUAAAAACUGCCC | 1791 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1465963.1 | asusugacAfuUfAfAfaaacugcccuL96 | 1268 | asGfsggdCa(G2p)uuuuuaAfuGfucaausgsu | 1529 | ACAUUGACAUUAAAAACUGCCCA | 1792 |
| AD-1465964.1 | ususgacaUfuAfAfAfaacugcccauL96 | 1269 | asUfsggdGc(Agn)guuuuuAfaUfgucaasus g | 1530 | CAUUGACAUUAAAAACUGCCCAA | 1793 |
| AD-1465965.1 | gsgsgaauAfcUfUfCfauugcugcauL96 | 1270 | asUfsgcdAg(C2p)aaugaaGfuAfuuuccsasc | 1531 | GUGGGAAUACUUCAUUGCCUGCAG | 1794 |
| AD-1465966.1 | asgsucauUfuGfGfGfacuaugcacuL96 | 1271 | asUfsugdCa(Tgn)agucccAfaAfugacusus c | 1532 | GAAGUCAUUUGGGACUAUGCACC | 1795 |
| AD-1465967.1 | gsgsggacuAfugGfCfAfccuguaauauL96 | 1272 | asUfsaudTa(C2p)aggugcAfuAfgucccsasa | 1533 | UUGGGACUAUGCACCUGUAAUAC | 1796 |
| AD-1465968.1 | csasccuguaAfuUfAfCfcagcgaauuL96 | 1273 | asdAsuudCgdCugudAuUfacaggugscsa | 1534 | UGCACCUGUAAUACCAGCGAAUA | 1797 |
| AD-1465969.1 | ugsguaauaCfCfAfGfcgaauaugguL96 | 1274 | asdCsscadTadTuccgcdTgGfuauuacasgsg | 1535 | CCUGUAAUACCAGCGAAUAUGGA | 1798 |
| AD-1465970.1 | gsusaauaccCfAfGfCfgaauauggauL96 | 1275 | asdTsccdAudAuucgdCuGfguauuacsasg | 1536 | CUGUAAUACCAGCGAAUAUGGAC | 1799 |
| AD-1465971.1 | asgsgucucCfafCfAfuuuggauaauL96 | 1276 | asUfsuadTc(C2p)aaaugcUfgAfgaccusgsu | 1537 | ACAGUCUCCAGCAUUUGGAUAAU | 1800 |
| AD-1465972.1 | gsusuauguaCfAfCfAfcaguacgauL96 | 1277 | asdTscgdTadCugugdTgTfacauaacsusu | 1538 | AAGUAUGUACACACAGUACGAA |  1801 |
| AD-1465973.1 | ususauguacAfcCfAfCfaguacgaauL96 | 1278 | asdTsucdGudAcugudGuTfacauaascsu | 1539 | AGUAUGUACACACAGUACGAAG | 1802 |
| AD-1465974.1 | asusguacAfcAfCfAfaguacgaagauL96 | 1279 | asUfscudTc(G2p)uacugucGfufacausasa | 1540 | UUAUGUACACACAGUACGAAGAU | 1803 |
| AD-1465975.1 | ugsguacaCfaCfAfGfuacgaagauuL96 | 1280 | asAfsucdTu(C2p)guacugUfgUfguacasusa | 1541 | UAUGUACACACAGUACGAAGAUG | 1804 |
| AD-1465976.1 | gsusacacaAfcGfUfCfuacgaagaugL96 | 1281 | asdCssaudCudTcguadCuGfuguguacsasu | 1542 | AUGUACACACAGUACGAAGAUGA | 1805 |
| AD-1465977.1 | asgsuacgAfaGfAfUfgagucucuL96 | 1282 | asGfsaadGg(Agn)cucaucUfuCfguacsgsu | 1543 | ACAGUACGAAGAUGAGUCCUUCA | 1806 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1465978.1 | gsusuacgaAfgGfUfGfagucccuucauL96 | 1283 | asUfsgadAg(G2p)acucaucCfuUfcguacsusg | 1544 | CAGUACGAAGAUGAGUCCUUCAC | 1807 |
| AD-1465979.1 | gsusgaauCfcCfAfAfuaugaaagauL96 | 1284 | asUfscudTu(C2p)auauugGfgAfuucacsusg | 1545 | CAGUGAAUC TABLE 6-continued Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1465994.1 | usgsagcacCfuAfUfCfaauggcuauuL96 | 1299 | asAfsuadGc(C2p)auugauAfgUfgcucasusg | 1560 | CAUGAGCCUAUCAAUGGCUAUG | 1823 |
| AD-1465996.1 | gsasuucuGfcUfUfUfgaugacacuuL96 | 1300 | asAfsgudGu(C2p)aucaaaGfcAfgaaucscsa | 1561 | UGGAUUCUGCUUUGAUGACACUG | 1824 |
|

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466010.1 | csgsucuacuUfCfacuggugcuL96 | 1314 | asdGscadCcdAagugdAaAfguagacgsusa | 1575 | UACGUCUACUUCACUUGGUGCU | 1838 |
| AD-1466011.1 | asusgaaaUfuAfCfUfagcacauaauL96 | 1315 | asUfsuadTg(Tgn)gcuaguAfaUfuucauscsc | 1576 | GGAUGAAAUUACUAGCACAUAAA | 1839 |
| AD-1466012.1 | aasauuacuaGfCfAfcauaaaguuuL96 | 1316 | asdAsacdTudTaugudGcUfaguaauususc | 1577 | GAAAUUACUAGCACAUAAAGUUG | 1840 |
| AD-1466013.1 | usascuagcaCfAfUfaaaguuggguL96 | 1317 | asdCsccdAadCuuuadTgUfgcuaguasasu | 1578 | AUUACUAGCACAUAAAGUUGGGA | 1841 |
| AD-1466014.1 | gsasgauggcAfUfUfuggcuucuguL96 | 1318 | asdCsagdAadGccaadAuGfccaucucscsc | 1579 | GGGAGAUGGCAUUUGGCUUCUGA | 1842 |
| AD-1466015.1 | gsusagcuAfugGfAfAfauaauccaauL96 | 1319 | asUfsugdGa(Tgn)uauuucAfuAfgcuacscsu | 1580 | AGGUAGCUAUGAAAUAAUCCAAG | 1843 |
| AD-1466016.1 | csasagauAfcUfGfAfAfugaagacacuL96 | 1320 | asGfsugdTc(Tgn)ucaucaGfuAfucuugsgsa | 1581 | UCCAAGAUACUGAUGAAGACACA | 1844 |
| AD-1466017.1 | gsasuacuGfaUfGfAfAfagacacagcuL96 | 1321 | asGfscudGu(G2p)ucuucaUfcAfguaucsusu | 1582 | AAGUACUGAUGAAGACACAGCU | 1845 |
| AD-1466018.1 | asasgacaCfaGfCfUfUfguuaacaauuL96 | 1322 | asAfsuudGu(Tgn)aacagcUfgUfgucuuuscsa | 1583 | UGAAGACAACAGCGUUAACAAUU | 1846 |
| AD-1466019.1 | asasguuuccUfAfGfAfguuagacauL96 | 1323 | asdTsgudCudAacucdTaGfgaaacuususg | 1584 | CAAAGUUUCCUAGAGUUAGACAU | 1847 |
| AD-1466020.1 | cscsuagaguUfAfGfacauaaaucuL96 | 1324 | asdGsaudTudAugucdTaAfcucuaggsasa | 1585 | UUCCUAGAGUUAGACAUAAAUCU | 1848 |
| AD-1466021.1 | usascaaguaAfGfAfAfcaggaugauL96 | 1325 | asdTsccdAudCcugudCuUfacuuguasgsa | 1586 | UCUACAAGUAAGACAGGAUGGAG | 1849 |
| AD-1466022.1 | gsusuucuCfaUfUfAfAfagacgaauL96 | 1326 | asUfsucdGu(G2p)ucuuaaUfgAfgaaacsusg | 1587 | CAGUUUCCAUUAAGACACCGAAA | 1850 |
| AD-1466023.1 | csasccaugCfcUfCfCfuuuauccuuL96 | 1327 | asGfsgadGa(Tgn)aaggaGfcAfuggugsusg | 1588 | CACACCAUGCUCCUUUAUCCUCG | 1851 |
| AD-1466024.1 | asgsgaccuuUfCfAfcccucuaaguL96 | 1328 | asdCsuudAgdAgggudGaAfagguccuscsg | 1589 | CGAGGACCUUUCACCUCUAAGA | 1852 |
| AD-1466025.1 | gsusgcuuCfaUfAfAfauccaaugauL96 | 1329 | asUfscadTu(G2p)gauuuaUfgAfagcacscsa | 1590 | UGGUGCUUCAUAAAUCCAUGAA | 1853 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466026.1 | usgcuucauAfAfAfuccaaugaauL96 | 1330 | asdTsucdAudTggaudTuAfugaagcascsc | 1591 | GGUGCUUCAUAAAUCCAUGAAA | 1854 |
| AD-1466027.1 | cscsaaugaaAfCfAfucucucccuL96 | 1331 | asdGsggdAadGagaudGuUfucauuggsasu | 1592 | AUCCAAUGAAACAUCUCUUCCCA | 1855 |
| AD-1466028.1 | acssuucUfgAfCfCfauaaucagauL96 | 1332 | asUfscudGa(Tgn)uauggucuCfaGfgaagusgsa | 1593 | UCACUUCCUGACCAUAAUCAGAA | 1856 |
| AD-1466029.1 | asasaugcUfuGfAfGfuaugaccgauL96 | 1333 | asUfscgdCu(C2p)auacucAfaGfcauuuscsa | 1594 | UGAAAUGCUUGAGUAUGACCGAA | 1857 |
| AD-1466030.1 | gscsuugaGfuAfUfGfaccgaagucuL96 | 1334 | asGfsacdTu(C2p)ggucauAfcUfcaagcsasu | 1595 | AUGCUUGAGUAUGACCGAAGUCA | 1858 |
| AD-1466031.1 | gsasguauGfaCfCfGfaagucacaauL96 | 1335 | asUfsugdTg(Agn)cuucggUfcAfuacucsasa | 1596 | UUGAGUAUGACCGAAGUCACAAG | 1859 |
| AD-1466032.1 | uasasugaCfgAfAfGfucacaagucuL96 | 1336 | asGfsacdTu(G2p)ugacuuCfgGfucauascsu | 1597 | AGUAUGACCGAAGUCACAAGUCC | 1860 |
| AD-1466033.1 | usgsaccgAfaGfUfCfacaagucuuL96 | 1337 | asAfsggdAc(Tgn)ugugacUfuCfggucasusa | 1598 | UAUGACCGAAGUCACAAGUCCUU | 1861 |
| AD-1466034.1 | gsasccgaaGfuCfAfcaagucuuuL96 | 1338 | asdAsagdGadCuugudGaCfuucgguscsasu | 1599 | AUGACCGAAGUCACAAGUCCUUC | 1862 |
| AD-1466035.1 | acsscgaaGfucUfAfCfaagucuucuL96 | 1339 | asGfsaadGg(Agn)cuugugAfcUfucgguscsa | 1600 | UGACCGAAGUCACAAGUCCUUCC | 1863 |
| AD-1466036.1 | uscsuccaGfaAfCfUfcagucagacaL96 | 1340 | asGfsucdTg(Agn)cugaguUfcUfggagasgsa | 1601 | UCUCUCCAGAACUCAGUCAGACA | 1864 |
| AD-1466036.2 | uscsuccaGfaAfCfUfcagucagacaL96 | 1340 | asGfsucdTg(Agn)cugaguUfcUfggagasgsa | 1601 | UCUCUCCAGAACUCAGUCAGACA | 1864 |
| AD-1466036.3 | uscsuccaGfaAfCfUfcagucagacaL96 | 1340 | asGfsucdTg(Agn)cugaguUfcUfggagasgsa | 1601 | UCUCUCCAGAACUCAGUCAGACA | 1864 |
| AD-1466037.1 | csusccaGfaAfCfUfCfagucagacauL96 | 1341 | asUfsgudCu(G2p)acugagUfcUfuggagsasg | 1602 | CUCUCCAGAACUCAGUCAGACAA | 1865 |
| AD-1466037.2 | csusccaGfaAfCfUfCfagucagacauL96 | 1341 | asUfsgudCu(G2p)acugagUfcUfuggagsasg | 1602 | CUCUCCAGAACUCAGUCAGACAA | 1865 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466037.3 | csusccagAfaCfUfCfagucagacauL96 | 1341 | asUfsgudCu(G2p)acugagUfuCfuggagsasg | 1602 | CUCUCCAGAACUCAGUCAGACAA | 1865 |
| AD-1466038.1 | csasgccaGfaCfAfAfaccucucucuL96 | 1342 | asGfsagdAg(Agn)gguuugUfcUfggcugsas a | 1603 | CUCAGCCAGACAAACCUCUCCC | 1866 |
| AD-1466038.2 | csasgccaGfaCfAfAfaccucucucuL96 | 1342 | asGfsagdAg(Agn)gguuugUfcUfggcugsas a | 1603 | CUCAGCCAGACAAACCUCUCCC | 1866 |
| AD-1466039.1 | ususcuaccUfUfCfugaaucuaguL96 | 1343 | asdCsuadGadTucagdAaGfguagaasusa | 1604 | UAUUCUACCCUUCUGAAUCUAGU | 1867 |
| AD-1466040.1 | csasucuccuAfCfUfcuccaaugauuL96 | 1344 | asdAsucdAudTgagadGuAfggagaugsasa | 1605 | UUCAUCUCCUACUCUCAUGAUA | 1868 |
| AD-1466041.1 | asuscaaaGfgAfAfUfuuaauccacuL96 | 1345 | asGfsugdGa(Tgn)uaaauuCfcUfuugausasg | 1606 | CUAUCAAAGGAAUUUAAUCCACU | 1869 |
| AD-1466042.1 | asasggaaUfuUfAfAfuccacugguuL96 | 1346 | asAfsccdAg(Tgn)ggauuaAfaUfuccuususg | 1607 | CAAAGGAAUUUAAUCCACUGGUU | 1870 |
| AD-1466043.1 | ususuaauccAfCfUfggunuauaguuL96 | 1347 | asdAscudAudAaccadGuGfgauuaaasusu | 1608 | AAUUUAAUCCACUGGUUUAUAGUG | 1871 |
| AD-1466044.1 | ususaauccaCfUfGfguuauaguguL96 | 1348 | asdCsacdTadTaaccdAgUfggauuaaasau | 1609 | AUUUAAUCCACUGGUUUAUAGUGG | 1872 |
| AD-1466045.1 | agsgauggUfaCfAfGfauuacauuguL96 | 1349 | asCfsaadTg(Tgn)aaucugUfaCfcaucususu | 1610 | AAAGAUGGUACAGAUUACAUUG A | 1873 |
| AD-1466046.1 | asusgguacaGfAfUfuacauugaguL96 | 1350 | asdCsucdAadTguaadTcUfguaccauscsu | 1611 | AGAUGGUACAGAUUACAUUGAG A | 1874 |
| AD-1466047.1 | ascsugauguUfAfGfGfgacaaacauL96 | 1351 | asdAsugdTudTguccdTaAfcaucagususu | 1612 | AAACUGAUGUUAGGACAAACAUC | 1875 |
| AD-1466048.1 | csusgaugUfuAfGfGfacaaacaucaL96 | 1352 | asGfsaudGu(Tgn)uguccuAfaCfaucagsusu | 1613 | AACUGAUGUUAGGACAAACAUCA | 1876 |
| AD-1466049.1 | gsasagaaAfuAfUfCfcuggauuauL96 | 1353 | asUfsaadTc(C2p)caggauAfUfucuucsasg | 1614 | CUGAAGAAAUAUCCUGGGAUUAU | 1877 |
| AD-1466050.1 | usgsaagacuCfUfGfaugauuucuL96 | 1354 | asdGsaadTadTcaucdAgAfgucucucasasu | 1615 | AUUGAAGACUCUGAUGAUAUUCC | 1878 |
| AD-1466051.1 | gsusaugaagAfGfCfaucucgaauL96 | 1355 | asdTsucdCgdAgaugdCuCfuucaucsauc | 1616 | GAGUAUGAGAGCAUCUCGGAAU | 1879 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466052.1 | asgsagcaucUfCfGfgaauucuuguL96 | 1356 | asdCsaadGadAuuccdGaGfaugcucususc | 1617 | GAAGAGCAUCCGGAAUUCUUGG | 1880 |
| AD-1466053.1 | uscsggaaUfuCfUfUfggccuauuuL96 | 377 | asAfsaudAg(G2p)accaagAfaUfuccgasgsa | 1618 | UCUCGGAAUUCUGGUCCUAUUA | 645 |
| AD-1466054.1 | csgsgaauUfcUfUfGfguccuauuauL96 | 1357 | asUfsaadTa(G2p)gaccaaGfaAfuuccgsasg | 1619 | CUCCGAAUUCUUGGUCCUAUUAU | 1881 |
| AD-1466055.1 | asasuucuugGfUfCfcuauuaucauL96 | 1358 | asdTsgadTadAuaggdAcCfaagaauusesc | 1620 | GGAAUUCUUGGUCCUAUUAUCAG | 1882 |
| AD-1466056.1 | uscsuuggUfcCfUfAfuuaucagaguL96 | 1359 | asCfsucdTg(Agn)uaauagGfaCfcaagasasu | 1621 | AUUCUGGUCCUAUUAUCAGAGC | 1883 |
| AD-1466057.1 | gsusccuaUfuAfUfCfagagcugaauL96 | 1360 | asUfsucdAg(C2p)ucugauAfaUfaggacscsa | 1622 | UGGUCCUAUUAUCAGAGCUGAAG | 1884 |
| AD-1466058.1 | usgsaaguggAfUfGfauguuauccuL96 | 1361 | asdGsgadTadAcaucdAuCfcacuucasgsc | 1623 | GCUGAAGUGGAUGAUGUUAUCCA | 1885 |
| AD-1466059.1 | gsasaguggaUfGfAfuguuauccauL96 | 1362 | asdTsggdAudAacaudCaUfccacuucsasg | 1624 | CUGAAGUGGAUGAUGUUAUCCAA | 1886 |
| AD-1466060.1 | asuscagaggGfAfAfagacuuauguL96 | 1363 | asdCsaudAadGucuudTcCfcucugausgsa | 1625 | UCAUCAGAGGGAAAGACUUAUGA | 1887 |
| AD-1466061.1 | agsgsggaaAfgAfCfUfUfuaugaagaauuL96 | 1364 | asAfsucdTu(C2p)auaaguCfuUfucccuscsu | 1626 | AGAGGGAAAGACUUAUGAAGAGAU | 1888 |
| AD-1466062.1 | aggscccaaauAfGfCfaguuauaccuL96 | 1365 | asdGsgudAudAaacugdCuAfuuuggcusgsa | 1627 | UCAGCCCAAAUAGCAGUUAUACCU | 1889 |
| AD-1466063.1 | asgscaguuaUfAfCfcuacguauguL96 | 1366 | asdCsaudAcdGuaggdTaUfaacugcusasu | 1628 | AUAGCAGUUAUACCUACGUAUGG | 1890 |
| AD-1466064.1 | gsasuauuCfaCfUfCfaggcuugauuL96 | 1367 | asAfsucdAa(G2p)ccugagUfgAfauaucsusu | 1629 | AAGAUAAUUCACUCAGGCUUGAUA | 1891 |
| AD-1466065.1 | gsgsaauaCfuAfCfAfuaaggacaguL96 | 1368 | asCfsugdTc(C2p)uuaugaAfgUfauuccsusu | 1630 | AAGGAAUACUACAUAAGGACAGC | 1892 |
| AD-1466066.1 | csusacauAfaGfGfAfcagcaacauuL96 | 1369 | asAfsugdTu(G2p)cuguccUfuAfuguagsusa | 1631 | UACUACAUAAGGACAGCAACAUG | 1893 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466067.1 | ascsauaaGfaAfCfAfgcaacaugcuL96 | 1370 | asGfscadTg(Tgn)ugcuguCfcUfuaugusasg | 1632 | CUACAUAAGGACAGCAACAUGCC | 1894 |
| AD-1466068.1 | ascsaugaGfaGfaGfAfAfuuugucuuauuL96 | 1371 | asUfsaadGa(C2p)aaauucUfcauguscsc | 1633 | GGACAUGAGAGAAUUUGUCU TABLE 6-continued Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466083.1 | asasagaagaGfCfUfgguacuauguL96 | 1386 | asdCsaudAgTaccadGcUfcuucuuususc | 1648 | GAAAAGAAGAGCUGGUACUAUGA | 1909 |
| AD-1466084.1 | asasgaagAfgCfUfGfguacuauganL96 | 1387 | asUfscadTa(G2p)uaccagCfuCfuucususu | 1649 | AAAAGAAGAGCUGGUACUAUGA | 1910 |
| AD-1466085.1 | aggsaagagcUfGfGfGfuacuaugaauL96 | 1388 | asdTsucdAudAguacdCaGfcucucucususu | 1650 | AAAGAAGAGCUGGUACUAUGAA | 1911 |
| AD-1466086.1 | gsasagagCfuGfGfUfacuaugaaauL96 | 1389 | asUfsuudCa(Tgn)aguaccAfgCfucuucsusu | 1651 | AAGAAGAGCUGGUACUAUGAAA | 1912 |
| AD-1466087.1 | asasgagcUfgGfUfAfcuaugaaauL96 | 1390 | asUfsuudTc(Agn)uaguacCfaGfcucuuscsu | 1652 | AGAAGAGCUGGUACUAUGAAAA | 1913 |
| AD-1466088.1 | asgsagcuGfgUfAfCfuauguaaguL96 | 1391 | asCfsuudTu(C2p)auaguaCfcAfgcucususu | 1653 | GAAGAGCUGGUACUAUGAAAAG | 1914 |
| AD-1466089.1 | gsasgcugguAfcUfUfaugaaaagauL96 | 1392 | asdTscudTudTcauadGuAfccagcucsusu | 1654 | AAGAGCUGGUACUAUGAAAAGA | 1915 |
| AD-1466090.1 | aggscugguUfacUfUfAfugaaaagaaguL96 | 1393 | asUfsucdTu(Tgn)ucauagUfaCfcagcsusc | 1655 | AGAGCUGGUACUAUGAAAAGAA | 1916 |
| AD-1466091.1 | gscscugguacUfAfUfGfaaaagaaguL96 | 1394 | asdCsucdCudTuucadTaGfuaccagcsusc | 1656 | GAGCUGGUACUAUGAAAAGAAG | 1917 |
| AD-1466092.1 | csusgguacCfuAfUfGfaaaagaaguuL96 | 1395 | asAfscudTc(Tgn)uucauAfgUfaccagscsu | 1657 | AGCUGGUACUAUGAAAAGAAGU | 1918 |
| AD-1466093.1 | cscsgaagUfucUfUfGfggagacucauL96 | 1396 | asUfsgadGu(C2p)uccaagAfacuucggsgsa | 1658 | UCCCGAAGUUCUUGGAGACUCAC | 1919 |
| AD-1466094.1 | gsasaguucCfuUfGfGfagacucacauL96 | 1397 | asUfsgudGa(G2p)ucuccaAfgAfacuucsgsg | 1659 | CCGAAGUUCUUGGAGACUCACAU | 1920 |
| AD-1466095.1 | usususcacgcCfAfUfUfaaugggauuL96 | 1398 | asdAsucdCcdAuuaadTgGfcgugaaascsu | 1660 | AGUUCACGCCAUUAAUGGGAUG | 1921 |
| AD-1466096.1 | asusuaaugGfAfUfgaucuacagucL96 | 1399 | asdCsugdTaGfaucadTccfcauuaausgsg | 1661 | CCAUUAAUGGGAUGAUCUACAGC | 1922 |
| AD-1466097.1 | gscsucccaaGfAfCfauucacguguuL96 | 1400 | asdCsacdGudGaaugdTcUfuggagcscsg | 1662 | CGGCUCCCAAGACAUUCACGUGG | 1923 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466098.1 | cscsaagaCfaUfCfcacgugguucuL96 | 1401 | asGfsaadCc(Agn)cgugaaUfgUfcuuggsgsa | 1663 | UCCCAAGACAUUCACGUGGUUCA | 1924 |
| AD-1466099.1 | asusucacgGfuGfGfUfucacuuucauL96 | 1402 | asUfsgadAa(G2p)ugaaccAfcGfugaauusgsu | 1664 | ACAUUCACGUGGUUCACUUUCAC | 1925 |
| AD-1466100.1 | asusgcaaacGfCfCfauuucuuauuL96 | 1403 | asdAsuadAgdAaaugdGcGfuuugcauscsc | 1665 | GGAUGCAAACGCCAUUUCUUAUC | 1926 |
| AD-1466101.1 | gscsaaacgcCfAfUfuucuuaucauL96 | 1404 | asdTsgadTadAgaaadTgGfcguuugcsasu | 1666 | AUGCAAACGCCAUUUCUUAUCAU | 1927 |
| AD-1466102.1 | uscsuuauCfaUfGfGfacagagacuuL96 | 1405 | asAfsgudCu(C2p)uguccaUfgAfuaagasasa | 1667 | UUUCUUAUCAUGGACAGAGACUG | 1928 |
| AD-1466103.1 | ususauauUfgGfAfCfagagacuguL96 | 1406 | asAfscadGu(C2p)ucugucCfaUfgauausgsa | 1668 | UCUUAUCAUGGACAGAGACUGUA | 1929 |
| AD-1466104.1 | usasagcacuGfGfUfaucauaucuuL96 | 1407 | asdAsgadTadTgauadCcAfgugcuuasgsu | 1669 | ACUAAGCACUGGUAUCAUAUCUG | 1930 |
| AD-1466105.1 | uscsuauauCfuGfGfAfUfucacagaucuL96 | 1408 | asGfsaudCu(G2p)ugaaucAfgAfuaugasusa | 1670 | UAUCAUAUCUGAUUCACAGAUCA | 1931 |
| AD-1466106.1 | asusaucugGfauUfUfCfacagaucaauL96 | 1409 | asUfsugdAu(C2p)ugugaaUfcAfgauausgsa | 383 | UCAUAUCUGAUUCACAGAUCAAG | 651 |
| AD-1466107.1 | usasaacaAfUfGfGfUfggaucuaauuL96 | 1410 | asAfsuadAg(Agn)uccaccAfuUfguuuasasu | 1671 | AUUAAACAUGGUGGAUCUUAU A | 1932 |
| AD-1466108.1 | asasacaauGfUfGfgaucuauauaUfL96 | 1410 | asdTsaudAadGauccdAcCfauugsuusasa | 1672 | UUAAACAUGGUGGAUCUUAUA A | 1933 |
| AD-1466109.1 | csasaugugGfAfUfCfcuuauaaugsuL96 | 1411 | asdCsaudTadTaagadTcCfaccauugsusu | 1673 | AACAAUGGUGGAUCUUAUAAUGC | 1934 |
| AD-1466110.1 | gsgsuggaucUfUfAfuaaugcuugguL96 | 1412 | asdCsaudGdGcdAuuauadAgFauccaccsasu | 1674 | AUGGUGGAUCUUAUAAUGCUUG G | 1935 |
| AD-1466111.1 | asusucuuauAfUfGfcuuggagguUfL96 | 1413 | asdCsacdTedCaagedAuUfauaagauscsc | 1675 | GGAUCUUAUAAUGCUUGGAGUG U | 1936 |
| AD-1466112.1 | csasaggqGfccCfAfAfacuaccuuL96 | 1414 | asAfsggdTa(G2p)uguuugGfcAfccuugsgsg | 1677 | CCCAAGGUGCCAAACACUACCUG | 1937 |
| AD-1466113.1 | cscsugcuAfuAfCfCfacagaguucuL96 | 1415 | asGfsaadCu(C2p)uguguAfuAfgcaggsasc | 1678 | GUCCUGCUAUACCAGAGUUCU | 1938 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466114.1 | csusgcuaUfaCfCfAfcagaguucuuL96 | 1416 | asAfsgadAc(Tgn)cuguggUfaUfagcagsgsa | 1679 | UCCUGCUAUACCAGAGUUCUA | 1939 |
| AD-1466115.1 | usasuaccacAfGfAfguucuauguuL96 | 1417 | asdAscadTadGaacudCuGfugguauasgsc | 1680 | GCUAUACCACAGAGUUCUAUGUA | 1940 |
| AD-1466116.1 | usasccccagAfGfUfucuauguaguL96 | 1418 | asdCsuadCadTagaadCuCfuguguasusa | 1681 | UAUACCACAGAGUUCUAUGUAGC | 1941 |
| AD-1466117.1 | cccsacagAfgUfUfCfuauguaguuL96 | 1419 | asAfsgcdTa(C2p)auagaaCfuCfuguggsusa | 1682 | UACCACAGAGUUCUAUGUAGCUU | 1942 |
| AD-1466118.1 | csascagaguUfCfUfauguagcuuL96 | 1420 | asdAsagdCudAcauadGaAfcucugusgsu | 1683 | ACCACAGAGUUCUAUGUAGCUUA | 1943 |
| AD-1466119.1 | aggsaguuCfuaUfUfGfuagcuuacauL96 | 1421 | asUfsgudAa(G2p)cuacauAfgAfacucusgsu | 1684 | ACAGAGUUCUAUGUAGCUUACAG | 1944 |
| AD-1466120.1 | aggsuucuauGfUfAfgcuuacaguuL96 | 1422 | asdAscudGudAagcudAcAfuagaacuscsu | 1685 | AGAGUUCUAUGUAGCUUACAGUU | 1945 |
| AD-1466121.1 | uscsuauGfUfaGfCfUfuacaguccuL96 | 1423 | asGfsgadAc(Tgn)guaagcUfaCfauagasasc | 1686 | GUUCUAUGUAGCUUACAGUCCA | 1946 |
| AD-1466122.1 | csasauucAfgAfUfGfccucuacaauL96 | 1424 | asUfsugdTa(G2p)aggcauCfuGfaauugscsc | 1687 | GGCAAUUCAGAUGCCUCUACAAU | 1947 |
| AD-1466123.1 | asasuucagAfUfGfCfcucuacaauuL96 | 1425 | asAfsuudGu(Agn)gaggcaUfcUfgaauusgsc | 1688 | GCAAUUCAGAUGCCUCUACAAUA | 1948 |
| AD-1466124.1 | ususcagaUfgCfCfUfcuacauaauL96 | 1426 | asUfsuadTu(G2p)uagaggCfaUfcugaasusu | 1689 | AAUUCAGAUGCCUCUACAUAAA | 1949 |
| AD-1466125.1 | asuscagUfuGfAfCfccaccuauuL96 | 1427 | asAfsaudAg(G2p)ugggucAfaAfcugasusu | 1690 | GAAUCAGUUUGACCCACCUAUUG | 1950 |
| AD-1466126.1 | uscsaguugAfCfCfccaccuauguuL96 | 1428 | asdCsaadTadGgugdGuCfaaacugasasu | 1691 | AAUCAGUUUGACCCACCUAUUGU | 1951 |
| AD-1466127.1 | csasguugaCfCfCfaccuauugguL96 | 1429 | asdAscadAudAggugdGgUfcaaacugsasu | 1692 | AUCAGUUUGACCCACCUAUUGUG | 1952 |
| AD-1466128.1 | csusauugUfGfCfUfagauauauuL96 | 1430 | asdAsaudAudAucuadGcCfacaauagsgsu | 1693 | ACCUAUUGUGGCUAGAUAUAUUA | 1953 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466129.1 | gsgscuagAfuAfUfAfuuaggaucuuL96 | 1431 | asAfsgadTc(C2p)uaauauAfuCfuagccsasc | 1694 | GUGGCUAGAUAUAUUAGGAUCUC | 1954 |
| AD-1466130.1 | gsasauauaUfuAfGfGfaucuccucauL96 | 1432 | asUfsggdAg(Agn)gauccuAfaAfauaucsusa | 1695 | UAGAUAUAUUAGGAUCUCUCCAA | 1955 |
| AD-1466131.1 | asgscaaaucAfCfAfgccuucuucguL96 | 1433 | asdCsgadAgdAagcudGuGfauuugcususg | 1696 | CAAGCAAAUCACAGCUUCUUCGU | 1956 |
| AD-1466132.1 | asgsguggCfuaGfAfAfauugaucuauL96 | 1434 | asUfsagdAu(C2p)aauuucUfaGfccacusgsc | 1697 | GCAGUGGCUAGAAUUGAUCUAC | 1957 |
| AD-1466133.1 | asasauugauCfUfAfcuaagaucuauL96 | 1435 | asdGsaudCudTgagudAgAfucaauuuscsu | 1698 | AGAAAUUGAUCUACUCAAGAUCA | 1958 |
| AD-1466134.1 | asusugaucCfuAfCfUfcaagaucaauL96 | 390 | asUfsugdAu(C2p)uugaguAfgAfucaauusu | 1699 | AAAUUGAUCUACUCAAGAUCAAG | 658 |
| AD-1466135.1 | asasaaugaAfuGfUfAfaagagcuauuL96 | 1436 | asAfsuadGc(Tgn)cuuuacAfuAfcauuuscsa | 1700 | UGAAAUGAUGUAAAGAGCUAU A | 1959 |
| AD-1466136.1 | asusguaaAfgAfGfCfuauaccaucuL96 | 1437 | asGfsaudGg(Tgn)auagcuCfuUfuacausasc | 1701 | GUAUGUAAAGAGCUAUACCAUCC | 1960 |
| AD-1466137.1 | asasgagcUfaUfAfCfcauccacuauL96 | 1438 | asUfsagdTg(G2p)augguaUfaGfcucuususa | 1702 | UAAAGAGCUAUACCAUCCACUAC | 1961 |
| AD-1466138.1 | csusccauGfguGfGfacaagauuuuL96 | 1439 | asAfsaadTc(Tgn)ugucccaCfcAfuggagsgsa | 1703 | UCCUCCAUGGUGACAAGAUUUU | 1962 |
| AD-1466139.1 | uscsccauGguGfGfAfcaagauuuuuL96 | 1440 | asdAsaadAudCuugudCcAfccauggasgsg | 1704 | CCUCCAUGGUGACAAGAUUUUU | 1963 |
| AD-1466140.1 | cscsauGguGfAfCfaagauuuuuuL96 | 1441 | asdAsaadAadTcuugdTcCfaccauggsasg | 1705 | CUCCAUGGUGACAAGAUUUUUG | 1964 |
| AD-1466141.1 | csasugguGgAcAfAfgauuuugaL96 | 1442 | asdCsaadAadAucuudGuCfcaccaugsgsa | 1706 | UCCAUGGUGACAAGAUUUUUGA | 1965 |
| AD-1466142.1 | asusgggaCfAfAfgauuuugauL96 | 1443 | asdTscadAadAaucudTgUfccaccausgsg | 1707 | CCAUGGUGACAAGAUUUUUGAA | 1966 |
| AD-1466143.1 | usgsggacAfAfGfauuuuuguL96 | 1444 | asdTsucdAadAaaucdTuGfuccaccasusg | 1708 | CAUGGUGACAAGAUUUUUGAA G | 1967 |
| AD-1466144.1 | gsgsuggacAfgAfAfuuuuugaagL96 | 1445 | asdCsuudCadAaaaudCuTfguccaccsasu | 1709 | AUGGUGACAAGAUUUUUGAAG G | 1968 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466145.1 | gsusggacaaGfAfUfuuuugaagguL96 | 1446 | asdCsucdTcdAaaaadTcTfuguccacscsa | 1710 | UGGUGGACAAGAUUUUGAAGGA | 1969 |
| AD-1466146.1 | usgsgacaAfgAfUfUfuuugaaggauL96 | 1447 | asUfsccdTu(C2p)aaaaauCfUfUfguccascsc | 1711 | GGUGGACAAGAUUUUGAAGGAA | 1970 |
| AD-1466147.1 | gsgsacaGfaUfUfUfUfuugaaggaauL96 | 1448 | asUfsucdCu(Tgn)caaaaaUfcUfuguccsasc | 1712 | GUGGACAAGAUUUUGAAGGAAA | 1971 |
| AD-1466148.1 | gsascaagAfuUfUfUfUfugaaggaaauU96 | 1449 | asUfsuudCc(Tgn)ucaaaaAfuCfuuguccsa | 1713 | UGGACAAGAUUUUGAAGGAAAU | 1972 |
| AD-1466149.1 | asccsaagaUfuUfUfUfgaaggaaauuU96 | 1450 | asAfsuudTc(C2p)uucaaaAfaUfcuuguscsc | 1714 | GGACAAGAUUUUGAAGGAAAUA | 1973 |
| AD-1466150.1 | csasagaUfuUfUfGfaaggaaauauU96 | 1451 | asUfsaudTu(C2p)cuucaaAfaAfucuugsusc | 1715 | GACAAGAUUUUGAAGGAAAUAC | 1974 |
| AD-1466151.1 | asasagauUfuUfGfAfaggaaauacuU96 | 1452 | asGfsuadTu(Tgn)ccuucaAfaAfaucuusgsu | 1716 | ACAAGAUUUUGAAGGAAAUACU | 1975 |
| AD-1466152.1 | asgsauuuuGfAfAfgaaauacuaU96 | 1453 | asdAsgudAudTuccudTcAfaaaaucususg | 1717 | CAAGAUUUUGAAGGAAAUACUA | 1976 |
| AD-1466153.1 | gsasuuuugAfAfGfgaaauacuauU96 | 1454 | asdTsagdTadTuccdTuCfaaaaaucsusu | 1718 | AAGAUUUUGAAGGAAAUACUAA | 1977 |
| AD-1466154.1 | asusuuuuGfaAfGfGfaaaauacuaauU96 | 1455 | asUfsuadGu(Agn)uuuccuUfcAfaaaauscsu | 1719 | AGAUUUUGAAGGAAAUACUAAU | 1978 |
| AD-1466155.1 | ususuuugAfaGfGfAfaaauacuaauU96 | 1456 | asAfsuudAg(Tgn)auuuccUfuCfaaaaausc | 1720 | GAUUUUGAAGGAAAUACUAAUA | 1979 |
| AD-1466156.1 | ususuugaAfgGfAfAfauacuaauaU96 | 1457 | asUfsaudTa(G2p)uauuucCfuUfcaaaaasau | 1721 | AUUUUGAAGGAAAUACUAAUAC | 1980 |
| AD-1466157.1 | ususuugaAfAfAfAfuacuaauacU96 | 1458 | asdGsuadTudAguaudTuCfcuucaaasasa | 1722 | UUUUGAAGGAAAUACUAAUACC | 1981 |
| AD-1466158.1 | ususugaaGfaAfAfAfuacuaauaccuL96 | 1459 | asdGsgudAudTaguadTuFfccuucaasasa | 1723 | UUUGAAGGAAAUACUAAUACCA | 1982 |
| AD-1466159.1 | ascsuaauAfcCfAfAfaggacauguuL96 | 1460 | asAfsacadTg(Tgn)ccuugGfuAfuuagusasu | 1724 | AUACUAAUACCAAGGACAUGUG | 1983 |

TABLE 6-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1466160.1 | csusaauaccAfAfAfggacauguguL96 | 1461 | asdCsacdAudGuccudTuGfguauuagsusa | 1725 | UACUAAUACCAAAGGACAUGUGA | 1984 |
| AD-1466161.1 | usasauaccaAfAfGfgacaugugauL96 | 1462 | asdTscadCadTguccdTuUfguauuasgsu | 1726 | ACUAAUACCAAAGGACAUGUGAA | 1985 |
| AD-1466162.1 | csasaucauuUfCfCfagguuuaucuL96 | 1463 | asdGsaudAadAccugdGaAfaugauugsgsg | 1727 | CCCAAUCAUUCCAGGUUUAUCC | 1986 |
| AD-1466163.1 | asuscauuucCfAfGfguuuauccguL96 | 1464 | asdCsggdAudAaaccdTgGfaaaugaususg | 1728 | CAAUCAUUCCAGGUUUAUCCGU | 1987 |
| AD-1466164.1 | asusggaUfcAfAfAfguaugcacuL96 | 1465 | asGfsugdCa(Agn)uacuuuGfaUfuccausgsu | 1729 | ACAUGGAAUCAAAGUAUUGCACU | 1988 |
| AD-1466165.1 | gscscuggAfacfUfCfuuuggcuguuL96 | 1466 | asAfscadGc(C2p)aaagagUfucfcaggcsgsa | 1730 | UCGCCUGGAACUCUUUGGCUGUG | 1989 |

TABLE 7

Unmodified Sense and Antisense Strand Sequences of Coagulation Factor V dsRNA Agents

| Duplex Name | Sense Sequence 5' to 3' | SEQ ID NO: | Range in NM_ 000130.4 | Antisense Sequence 5' to 3' | SEQ ID NO: | Range in NM_ 000130.4 |
|---|---|---|---|---|---|---|
| AD-1410569 | CCACAAACUCAAGUUUGAAUU | 60 | 291-311 | AAUUCAAACUUGAGUUUGUGGGC | 191 | 289-311 |
| AD-1410577 | AUCUUUCUGUAACUUCCUUUU | 61 | 309-329 | AAAAGGAAGUUACAGAAAGAUUC | 192 | 307-329 |
| AD-1410605 | AGUAUGAACCAUAUUUUAAGU | 15 | 348-368 | ACUUAAAAUAUGGUUCAUACUCU | 16 | 346-368 |
| AD-1410628 | CUACCAUUUCAGGACUUCUUU | 62 | 384-404 | AAAGAAGUCCUGAAAUGGUAGAU | 193 | 382-404 |
| AD-109252 | CAUGCCUCACACACAUCUAUU | 1990 | 642-662 | AAUAGAUGUGUGUGAGGCAUGGA | 2050 | 640-662 |
| AD-1410821 | AUGCCUCACACACAUCUAUUU | 712 | 643-663 | AAAUAGAUGUGUGUGAGGCAUGG | 2051 | 641-663 |
| AD-1410822 | UGCCUCACACACAUCUAUUAU | 713 | 644-664 | AUAAUAGAUGUGUGUGAGGCAUG | 2052 | 642-664 |
| AD-109255 | GCCUCACACACAUCUAUUACU | 11 | 645-665 | AGUAAUAGAUGUGUGUGAGGCAU | 2053 | 643-665 |
| AD-1410823 | CCUCACACACAUCUAUUACUU | 714 | 646-666 | AAGUAAUAGAUGUGUGUGAGGCA | 2054 | 644-666 |
| AD-1410824 | CUCACACACAUCUAUUACUCU | 13 | 647-667 | AGAGUAAUAGAUGUGUGUGAGGC | 2055 | 645-667 |
| AD-1410825 | UCACACACAUCUAUUACUCCU | 66 | 648-668 | AGGAGUAAUAGAUGUGUGUGAGG | 197 | 646-668 |
| AD-1410831 | CAUCUAUUACUCCCAUGAAAU | 1991 | 655-675 | AUUUCAUGGGAGUAAUAGAUGUG | 2056 | 653-675 |
| AD-1410845 | UCUGAUCGAGGAUUUCAACUU | 67 | 676-696 | AAGUUGAAAUCCUCGAUCAGAUU | 198 | 674-696 |
| AD-1410866 | GGGACACAGAAGACGUUUGAU | 1992 | 749-769 | AUCAAACGUCUUCUGUGUCCCAC | 2057 | 747-769 |
| AD-1410867 | GGACACAGAAGACGUUUGACU | 1993 | 750-770 | AGUCAAACGUCUUCUGUGUCCCA | 2058 | 748-770 |
| AD-1410868 | GACACAGAAGACGUUUGACAU | 1994 | 751-771 | AUGUCAAACGUCUUCUGUGUCCC | 2059 | 749-771 |
| AD-109319 | GAAGACGUUUGACAAGCAAAU | 717 | 757-777 | AUUUGCUUGUCAAACGUCUUCUG | 2060 | 755-777 |
| AD-109322 | GACGUUUGACAAGCAAAUCGU | 719 | 760-780 | ACGAUUUGCUUGUCAAACGUCUU | 2061 | 758-780 |
| AD-1410876 | ACGUUUGACAAGCAAAUCGUU | 1995 | 761-781 | AACGAUUUGCUUGUCAAACGUCU | 2062 | 759-781 |
| AD-1410877 | CGUUUGACAAGCAAAUCGUGU | 1996 | 762-782 | ACACGAUUUGCUUGUCAAACGUC | 2063 | 760-782 |
| AD-109325 | GUUUGACAAGCAAAUCGUGCU | 1997 | 763-783 | AGCACGAUUUGCUUGUCAAACGU | 2064 | 761-783 |
| AD-1410878 | UUUGACAAGCAAAUCGUGCUU | 1998 | 764-784 | AAGCACGAUUUGCUUGUCAAACG | 2065 | 762-784 |
| AD-1410927 | CCUAAUGUACACAGUCAAUGU | 1999 | 832-852 | ACAUUGACUGUGUACAUUAGGGA | 2066 | 830-852 |
| AD-1410928 | CUAAUGUACACAGUCAAUGGU | 2000 | 833-853 | ACCAUUGACUGUGUACAUUAGGG | 2067 | 831-853 |
| AD-109396 | UAAUGUACACAGUCAAUGGAU | 2001 | 834-854 | AUCCAUUGACUGUGUACAUUAGG | 2068 | 832-854 |
| AD-1410929 | AAUGUACACAGUCAAUGGAUU | 724 | 835-855 | AAUCCAUUGACUGUGUACAUUAG | 2069 | 833-855 |
| AD-1410994 | AUUAUUCUCCAUUCAUUUCAU | 70 | 940-960 | AUGAAAUGAAUGGAGAAUAAUUC | 201 | 938-960 |
| AD-109601 | AAAGUGGAUCAUAUCUUCUCU | 31 | 1057-1077 | AGAGAAGAUAUGAUCCACUUUCC | 162 | 1055-1077 |
| AD-1411138 | CCAGGAAUCUUAAGAAAAUAU | 72 | 1143-1163 | AUAUUUUCUUAAGAUUCCUGGUU | 203 | 1141-1163 |
| AD-1411203 | GGACUAUGCACCUGUAAUACU | 2002 | 1228-1248 | AGUAUUACAGGUGCAUAGUCCCA | 2070 | 1226-1248 |
| AD-1411204 | GACUAUGCACCUGUAAUACCU | 2003 | 1229-1249 | AGGUAUUACAGGUGCAUAGUCCC | 2071 | 1227-1249 |
| AD-1411205 | ACUAUGCACCUGUAAUACCAU | 2004 | 1230-1250 | AUGGUAUUACAGGUGCAUAGUCC | 2072 | 1228-1250 |
| AD-1411206 | CUAUGCACCUGUAAUACCAGU | 2005 | 1231-1251 | ACUGGUAUUACAGGUGCAUAGUC | 2073 | 1229-1251 |
| AD-109757 | GCACCUGUAAUACCAGCGAAU | 2006 | 1235-1255 | AUUCGCUGGUAUUACAGGUGCAU | 2074 | 1233-1255 |
| AD-1411210 | CACCUGUAAUACCAGCGAAUU | 759 | 1236-1256 | AAUUCGCUGGUAUUACAGGUGCA | 1015 | 1234-1256 |
| AD-109759 | ACCUGUAAUACCAGCGAAUAU | 2007 | 1237-1257 | AUAUUCGCUGGUAUUACAGGUGC | 2075 | 1235-1257 |
| AD-1411211 | CCUGUAAUACCAGCGAAUAUU | 2008 | 1238-1258 | AAUAUUCGCUGGUAUUACAGGUG | 2076 | 1236-1258 |

TABLE 7-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1411212 | CUGUAAUACCAGCGAAUAUGU | 2009 | 1239-1259 | ACAUAUUCGCUGGUAUUACAGGU | 2077 | 1237-1259 |
| AD-1411213 | UGUAAUACCAGCGAAUAUGGU | 760 | 1240-1260 | ACCAUAUUCGCUGGUAUUACAGG | 2078 | 1238-1260 |
| AD-1411214 | GUAAUACCAGCGAAUAUGGAU | 761 | 1241-1261 | AUCCAUAUUCGCUGGUAUUACAG | 2079 | 1239-1261 |
| AD-1411215 | UAAUACCAGCGAAUAUGGACU | 2010 | 1242-1262 | AGUCCAUAUUCGCUGGUAUUACA | 2080 | 1240-1262 |
| AD-1411226 | UCAGCAUUUGGAUAAUUUCUU | 73 | 1276-1296 | AAGAAAUUAUCCAAAUGCUGAGA | 204 | 1274-1296 |
| AD-1411342 | ACACUCAAAAUCGUGUUCAAU | 76 | 1433-1453 | AUUGAACACGAUUUUGAGUGUGU | 207 | 1431-1453 |
| AD-110052 | UAAGUGGAACAUCUUAGAGUU | 33 | 1594-1614 | AACUCUAAGAUGUUCCACUUAUA | 164 | 1592-1614 |
| AD-1411480 | UAACAAGACCAUACUACAGUU | 78 | 1647-1667 | AACUGUAGUAUGGUCUUGUUAAG | 209 | 1645-1667 |
| AD-1411743 | CAUUCAUCUAUGGAAAGAGGU | 81 | 2034-2054 | ACCUCUUUCCAUAGAUGAAUGAG | 212 | 2032-2054 |
| AD-110518 | UUGGAACUUGGAUGUUAACUU | 36 | 2118-2138 | AAGUUAACAUCCAAGUUCCAACA | 167 | 2116-2138 |
| AD-1411798 | UAACUUCCAUGAAUUCUAGUU | 82 | 2133-2153 | AACUAGAAUUCAUGGAAGUUAAC | 213 | 2131-2153 |
| AD-1411972 | CCGAAACUCAUCAUUGAAUCU | 84 | 2362-2382 | AGAUUCAAUGAUGAGUUUCGGAA | 215 | 2360-2382 |
| AD-110844 | UCAAACACAGAUAUAAUUGUU | 38 | 2444-2464 | AACAAUUAUAUCUGUGUUUGAAG | 169 | 2442-2464 |
| AD-1412040 | GUUGGUUCAAAUUAUUCUUCU | 86 | 2462-2482 | AGAAGAAUAAUUUGAACCAACAA | 217 | 2460-2482 |
| AD-1412095 | ACUCAGUUCUCAAUUCUUCCU | 88 | 2595-2615 | AGGAAGAAUUGAGAACUGAGUUC | 219 | 2593-2615 |
| AD-1412163 | UACGUCUACUUUCACUUGGUU | 89 | 2685-2705 | AACCAAGUGAAAGUAGACGUAUC | 220 | 2683-2705 |
| AD-111287 | AAGUAACUCAUCUAAGAUUUU | 39 | 2953-2973 | AAAAUCUUAGAUGAGUUACUUUG | 170 | 2951-2973 |
| AD-1412482 | CUAGAGUUAGACAUAAAUCUU | 93 | 3150-3170 | AAGAUUUAUGUCUAACUCUAGGA | 224 | 3148-3170 |
| AD-1412539 | UUUCUCAUUAAGACACGAAAU | 95 | 3218-3238 | AUUUCGUGUCUUAAUGAGAAACU | 226 | 3216-3238 |
| AD-1412582 | UGAAGCCUACAACACAUUUUU | 96 | 3304-3324 | AAAAAUGUGUUGUAGGCUUCACU | 227 | 3302-3324 |
| AD-1412622 | AAUCCAAUGAAACAUCUCUUU | 97 | 3360-3380 | AAAGAGAUGUUUCAUUGGAUUUA | 228 | 3358-3380 |
| AD-1412733 | UCAAAUGCACUCUACUUCAGU | 100 | 3553-3573 | ACUGAAGUAGAGUGCAUUUGAUC | 231 | 3551-3573 |
| AD-112396 | UACUCUCAAUGAUACUUUUCU | 43 | 4633-4653 | AGAAAAGUAUCAUUGAGAGUAGG | 174 | 4631-4653 |
| AD-1413210 | CUAUCAAAGGAAUUUAAUCCU | 109 | 4652-4672 | AGGAUUAAAUUCCUUUGAUAGAA | 240 | 4650-4672 |
| AD-1413286 | ACUAUGCUGAAAUUGAUUAUU | 111 | 4755-4775 | AAUAAUCAAUUUCAGCAUAGUCA | 242 | 4753-4775 |
| AD-112618 | AAACAGAAGAAAUUAUUACAU | 44 | 4876-4896 | AUGUAAUAAUUUCUUCUGUUUCC | 175 | 4874-4896 |
| AD-112760 | AGCACUUUUACCAAACGUGAU | 45 | 5021-5041 | AUCACGUUUGGUAAAAGUGCUGU | 176 | 5019-5041 |
| AD-1413517 | UUAUCCAAGUUCGUUUUAAAU | 114 | 5109-5129 | AUUUAAAACGAACUUGGAUAACA | 245 | 5107-5129 |
| AD-1413605 | AUGCUGUUCAGCCAAAUAGCU | 115 | 5238-5258 | AGCUAUUUGGCUGAACAGCAUUA | 246 | 5236-5258 |
| AD-1413615 | UAGCAGUUAUACCUACGUAUU | 116 | 5254-5274 | AAUACGUAGGUAUAACUGCUAUU | 247 | 5252-5274 |
| AD-113137 | GAGAGAAUUUGUCUUACUAUU | 46 | 5443-5463 | AAUAGUAAGACAAAUUCUCUCAU | 177 | 5441-5463 |
| AD-113331 | GACAUUCACGUGGUUCACUUU | 47 | 5657-5677 | AAAGUGAACCACGUGAAUGUCUU | 178 | 5655-5677 |
| AD-1413936 | CUGGUUCAUUUAAAACUCUUU | 117 | 5742-5762 | AAAGAGUUUUAAAUGAACCAGGC | 248 | 5740-5762 |
| AD-113467 | GAGCAGGGAUGCAAACGCCAU | 2011 | 5823-5843 | AUGGCGUUUGCAUCCCUGCUCUC | 2081 | 5821-5843 |
| AD-113468 | AGCAGGGAUGCAAACGCCAUU | 2012 | 5824-5844 | AAUGGCGUUUGCAUCCCUGCUCU | 2082 | 5822-5844 |
| AD-113471 | AGGGAUGCAAACGCCAUUUCU | 2013 | 5827-5847 | AGAAAUGGCGUUUGCAUCCCGC | 2083 | 5825-5847 |
| AD-113472 | GGGAUGCAAACGCCAUUUCUU | 2014 | 5828-5848 | AAGAAAUGGCGUUUGCAUCCCUG | 2084 | 5826-5848 |

TABLE 7-continued

Unmodified Sense and Antisense Strand Sequences of Coagulation Factor V dsRNA Agents

| Duplex Name | Sense Sequence 5' to 3' | SEQ ID NO: | Range in NM_ 000130.4 | Antisense Sequence 5' to 3' | SEQ ID NO: | Range in NM_ 000130.4 |
|---|---|---|---|---|---|---|
| AD-1414007 | GGAUGCAAACGCCAUUUCUUU | 2015 | 5829-5849 | AAAGAAAUGGCGUUUGCAUCCCU | 2085 | 5827-5849 |
| AD-113474 | GAUGCAAACGCCAUUUCUUAU | 2016 | 5830-5850 | AUAAGAAAUGGCGUUUGCAUCCC | 2086 | 5828-5850 |
| AD-1414008 | AUGCAAACGCCAUUUCUUAUU | 888 | 5831-5851 | AAUAAGAAAUGGCGUUUGCAUCC | 1144 | 5829-5851 |
| AD-1414009 | UGCAAACGCCAUUUCUUAUCU | 17 | 5832-5852 | AGAUAAGAAAUGGCGUUUGCAUC | 18 | 5830-5852 |
| AD-113477 | GCAAACGCCAUUUCUUAUCAU | 889 | 5833-5853 | AUGAUAAGAAAUGGCGUUUGCAU | 2087 | 5831-5853 |
| AD-1414010 | CAAACGCCAUUUCUUAUCAUU | 2017 | 5834-5854 | AAUGAUAAGAAAUGGCGUUUGCA | 2088 | 5832-5854 |
| AD-1414011 | AAACGCCAUUUCUUAUCAUGU | 2018 | 5835-5855 | ACAUGAUAAGAAAUGGCGUUUGC | 2089 | 5833-5855 |
| AD-1414012 | AACGCCAUUUCUUAUCAUGGU | 2019 | 5836-5856 | ACCAUGAUAAGAAAUGGCGUUUG | 2090 | 5834-5856 |
| AD-1414013 | ACGCCAUUUCUUAUCAUGGAU | 2020 | 5837-5857 | AUCCAUGAUAAGAAAUGGCGUUU | 2091 | 5835-5857 |
| AD-1414014 | CGCCAUUUCUUAUCAUGGACU | 2021 | 5838-5858 | AGUCCAUGAUAAGAAAUGGCGUU | 2092 | 5836-5858 |
| AD-1414044 | AUGGGACUAAGCACUGGUAUU | 2022 | 5876-5896 | AAUACCAGUGCUUAGUCCCAUUG | 2093 | 5874-5896 |
| AD-1414045 | UGGGACUAAGCACUGGUAUCU | 2023 | 5877-5897 | AGAUACCAGUGCUUAGUCCCAUU | 2094 | 5875-5897 |
| AD-113522 | GGGACUAAGCACUGGUAUCAU | 2024 | 5878-5898 | AUGAUACCAGUGCUUAGUCCCAU | 2095 | 5876-5898 |
| AD-1414046 | GGACUAAGCACUGGUAUCAUU | 2025 | 5879-5899 | AAUGAUACCAGUGCUUAGUCCCA | 2096 | 5877-5899 |
| AD-113526 | CUAAGCACUGGUAUCAUAUCU | 2026 | 5882-5902 | AGAUAUGAUACCAGUGCUUAGUC | 2097 | 5880-5902 |
| AD-1414048 | UAAGCACUGGUAUCAUAUCUU | 892 | 5883-5903 | AAGAUAUGAUACCAGUGCUUAGU | 2098 | 5881-5903 |
| AD-1414049 | AAGCACUGGUAUCAUAUCUGU | 2027 | 5884-5904 | ACAGAUAUGAUACCAGUGCUUAG | 2099 | 5882-5904 |
| AD-113529 | AGCACUGGUAUCAUAUCUGAU | 2028 | 5885-5905 | AUCAGAUAUGAUACCAGUGCUUA | 2100 | 5883-5905 |
| AD-113530 | GCACUGGUAUCAUAUCUGAUU | 2029 | 5886-5906 | AAUCAGAUAUGAUACCAGUGCUU | 2101 | 5884-5906 |
| AD-1414050 | CACUGGUAUCAUAUCUGAUUU | 2030 | 5887-5907 | AAAUCAGAUAUGAUACCAGUGCU | 2102 | 5885-5907 |
| AD-1414053 | UGGUAUCAUAUCUGAUUCACU | 2031 | 5890-5910 | AGUGAAUCAGAUAUGAUACCAGU | 2103 | 5888-5910 |
| AD-1414074 | UCAGAGUUUCUGGGUUACUGU | 119 | 5921-5941 | ACAGUAACCCAGAAACUCUGAAG | 250 | 5919-5941 |
| AD-1414139 | AGAAUUUGCCUCUAAACCUUU | 120 | 6010-6030 | AAAGGUUUAGAGGCAAAUUCUGC | 251 | 6008-6030 |
| AD-1414213 | CUGAAGUCCUGCUAUACCACU | 2032 | 6098-6118 | AGUGGUAUAGCAGGACUUCAGGU | 2104 | 6096-6118 |
| AD-1414218 | CUGCUAUACCACAGAGUUCUU | 19 | 6106-6126 | AAGAACUCUGUGGUAUAGCAGGA | 2105 | 6104-6126 |
| AD-113751 | UGCUAUACCACAGAGUUCUAU | 2033 | 6107-6127 | AUAGAACUCUGUGGUAUAGCAGG | 2106 | 6105-6127 |
| AD-1414219 | GCUAUACCACAGAGUUCUAUU | 2034 | 6108-6128 | AAUAGAACUCUGUGGUAUAGCAG | 2107 | 6106-6128 |
| AD-113753 | CUAUACCACAGAGUUCUAUGU | 2035 | 6109-6129 | ACAUAGAACUCUGUGGUAUAGCA | 2108 | 6107-6129 |
| AD-1414220 | UAUACCACAGAGUUCUAUGUU | 901 | 6110-6130 | AACAUAGAACUCUGUGGUAUAGC | 2109 | 6108-6130 |
| AD-1414221 | AUACCACAGAGUUCUAUGUAU | 2036 | 6111-6131 | AUACAUAGAACUCUGUGGUAUAG | 2110 | 6109-6131 |
| AD-1414222 | UACCACAGAGUUCUAUGUAGU | 902 | 6112-6132 | ACUACAUAGAACUCUGUGGUAUA | 2111 | 6110-6132 |
| AD-113757 | ACCACAGAGUUCUAUGUAGCU | 2037 | 6113-6133 | AGCUACAUAGAACUCUGUGGUAU | 2112 | 6111-6133 |
| AD-113758 | CCACAGAGUUCUAUGUAGCUU | 903 | 6114-6134 | AAGCUACAUAGAACUCUGUGGUA | 2113 | 6112-6134 |
| AD-1414223 | CACAGAGUUCUAUGUAGCUUU | 904 | 6115-6135 | AAAGCUACAUAGAACUCUGUGGU | 1160 | 6113-6135 |
| AD-1414226 | AGAGUUCUAUGUAGCUUACAU | 905 | 6118-6138 | AUGUAAGCUACAUAGAACUCUGU | 1161 | 6116-6138 |
| AD-113763 | GAGUUCUAUGUAGCUUACAGU | 2038 | 6119-6139 | ACUGUAAGCUACAUAGAACUCUG | 2114 | 6117-6139 |
| AD-113764 | AGUUCUAUGUAGCUUACAGUU | 906 | 6120-6140 | AACUGUAAGCUACAUAGAACUCU | 1162 | 6118-6140 |

TABLE 7-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1414229 | UCUAUGUAGCUUACAGUUCCU | 907 | 6123-6143 | AGGAACUGUAAGCUACAUAGAAC | 2115 | 6121-6143 |
| AD-1414230 | CUAUGUAGCUUACAGUUCCAU | 2039 | 6124-6144 | AUGGAACUGUAAGCUACAUAGAA | 2116 | 6122-6144 |
| AD-1414231 | UAUGUAGCUUACAGUUCCAAU | 2040 | 6125-6145 | AUUGGAACUGUAAGCUACAUAGA | 2117 | 6123-6145 |
| AD-1414235 | UAGCUUACAGUUCCAACCAGU | 2041 | 6129-6149 | ACUGGUUGGAACUGUAAGCUACA | 2118 | 6127-6149 |
| AD-1414275 | GAAUGUGAUGUAUUUUAAUGU | 122 | 6184-6204 | ACAUUAAAAUACAUCACAUUCCU | 253 | 6182-6204 |
| AD-113890 | ACCUAUUGUGGCUAGAUAUAU | 2042 | 6247-6267 | AUAUAUCUAGCCACAAUAGGUGG | 2119 | 6245-6267 |
| AD-113891 | CCUAUUGUGGCUAGAUAUAUU | 2043 | 6248-6268 | AAUAUAUCUAGCCACAAUAGGUG | 2120 | 6246-6268 |
| AD-1414321 | CUAUUGUGGCUAGAUAUAUUU | 914 | 6249-6269 | AAAUAUAUCUAGCCACAAUAGGU | 1170 | 6247-6269 |
| AD-1414322 | UAUUGUGGCUAGAUAUAUUAU | 2044 | 6250-6270 | AUAAAUAUCUAGCCACAAUAGG | 2121 | 6248-6270 |
| AD-1414323 | AUUGUGGCUAGAUAUAUUAGU | 2045 | 6251-6271 | ACUAAUAUAUCUAGCCACAAUAG | 2122 | 6249-6271 |
| AD-1414324 | UUGUGGCUAGAUAUAUUAGGU | 2046 | 6252-6272 | ACCUAAUAUAUCUAGCCACAAUA | 2123 | 6250-6272 |
| AD-113896 | UGUGGCUAGAUAUAUUAGGAU | 2047 | 6253-6273 | AUCCUAAUAUAUCUAGCCACAAU | 2124 | 6251-6273 |
| AD-1414325 | GUGGCUAGAUAUAUUAGGAUU | 2048 | 6254-6274 | AAUCCUAAUAUAUCUAGCCACAA | 2125 | 6252-6274 |
| AD-1414326 | GGCUAGAUAUAUUAGGAUCUU | 915 | 6256-6276 | AAGAUCCUAAUAUAUCUAGCCAC | 2126 | 6254-6276 |
| AD-113900 | GCUAGAUAUAUUAGGAUCUCU | 2049 | 6257-6277 | AGAGAUCCUAAUAUAUCUAGCCA | 2127 | 6255-6277 |
| AD-1414544 | CCUCUGAAAUGUAUGUAAAGU | 126 | 6579-6599 | ACUUUACAUACAUUUCAGAGGAC | 257 | 6577-6599 |
| AD-114455 | CUGUGUUAAAUGUUAACAGUU | 48 | 6896-6916 | AACUGUUAACAUUUAACACAGCG | 179 | 6894-6916 |
| AD-114469 | ACAGUUUUCCACUAUUUCUCU | 21 | 6911-6931 | AGAGAAAUAGUGGAAAACUGUUA | 22 | 6909-6931 |

TABLE 8

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO | mRNA target sequence 5' to 3' | SEQ ID NO: |
|---|---|---|---|---|---|---|
| AD-1410569 | cscsacaaAfcUfCfAfaaguuugaauuL96 | 323 | asAfsuucAfaAfCfuugaGfuUfugugsgsc | 457 | GCCCACAAACUCAAGUUGAAUC | 591 |
| AD-1410577 | asuscuuuCfgGfUfAfacuuccuuuuL96 | 324 | asAfsaagGfaAfGfuuacAfgAfaagaususc | 458 | GAAUCUUUCUGUAACUCCUUUA | 592 |
| AD-1410605 | aggsuaugAfaCfCfAfuauuuuaaguL96 | 325 | asCfsuuaAfaAfUfauggUfuCfauacuscsu | 459 | AGAGUAUGAACCAUAUUUAAGA | 593 |
| AD-1410628 | csusaccaUfuUfCfAfggacuucuuuL96 | 326 | asAfsagaAfgUfCfcugaAfaUfgguagsasu | 460 | AUCUACCAUUCAGGACUUCUUG | 594 |
| AD-109252 | csasugcCfuCfAfCfacacucuauuL96 | 2128 | asAfsuagAfugUfCfuguGfaGfcaugsgsa | 2206 | UCCAUGCCUCACACAUCUAUU | 2290 |
| AD-1410821 | asusgccUfcAfCfAfCfacaucuauuuL96 | 2129 | asAfsauaGfauUfGfugugUfgAfggcausgsg | 2207 | CCAUGCCUCACACAUCUAUUA | 1748 |
| AD-1410822 | ugsgccucAfcAfCfAfCfacucuauauL96 | 2130 | asUfsaauAfgAfUfguguGfuGfaggcasusg | 2208 | CAUGCCUCACACAUCUAUUAC | 1749 |
| AD-109255 | gscscucaCfacAfCfAfaucuauuacuL96 | 2131 | asGfsuaaUfaGfAfugugUfgUfgaggcsasu | 2209 | AUGCCUCACACAUCUAUUACU | 1750 |
| AD-1410823 | cscsucacAfcAfCfAfucuauuacuL96 | 2132 | asAfsguaAfuAfGfauguGfuGfugaggscsa | 2210 | UGCCUCACACAUCUAUUACUC | 1751 |
| AD-1410824 | csuscacaCfaCfAfCfufcuauuacucuL96 | 2133 | asGfsaguAfuAfAfgaugUfgUfguagsgsc | 2211 | GCCUCACACAUCUAUUACUCC | 1752 |
| AD-1410825 | uscsacacAfcAfUfCfuauuacucccL96 | 330 | asGfsgagUfaAfUfagauGfuGfuguagsgsg | 464 | CCUCACACAUCUAUUACUCCC | 598 |
| AD-1410831 | csaaucuaUfuAfCfUfccaugaaauL96 | 2134 | asUfsuucAfuGfGfgaguAfaUfagaugsusg | 2212 | CACAUCUAUUACUCCCAUGAAAA | 2291 |
| AD-1410845 | uscsugauCfgAfGfGfauuucaacuL96 | 331 | asAfsguuGfaAfAfucucGfaFfucagasusu | 465 | AAUCUGAUCGAGGAUUUCAACUC | 599 |
| AD-1410866 | gsgsgacaCfaGfAfAfgacguuugauL96 | 2135 | asUfscaaAfcGfUfcuucUfgUfguccsasc | 2213 | GUGGGACACAGAGACGUUUGAC | 2292 |
| AD-1410867 | gsgsgacaCfaGfAfAfgacguuugacuL96 | 2136 | asGfsucaAfaCfGfucuuCfuGfuguccscsa | 2214 | UGGGACACAGAGACGUUUGACA | 2293 |

TABLE 8-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO | mRNA target sequence 5' to 3' | SEQ ID NO: |
|---|---|---|---|---|---|---|
| AD-1410868 | gsascacaGfaAfGfAfcguuugacauL96 | 2137 | asUfsgucAfaAfCfgucuUfcUfgugucscsc | 2215 | GGGACACAGAAGACGUUUGACAA | 2294 |
| AD-109319 | gsasagacGfuUfUfGfacaagcaaauL96 | 1231 | asUfsuugCfuUfGfucaaAfcGfucuucsusg | 2216 | CAGAAGACGUUUGACAAGCAAAU | 1755 |
| AD-109322 | gsascguuUfgAfCfAfAfagcaaaucguL96 | 2138 | asCfsgauUfugGfCfuugucCfaAfacgucsusu | 2217 | AAGACGUUUGACAAGCAAAUCGU | 1757 |
| AD-1410876 | ascsguuuGfacCfAfAfgcaaaucguuL96 | 2139 | asAfscgaUfuUfGfcuugUfcAfaacguscsu | 2218 | AGACGUUUGACAAGCAAAUCGUG | 2295 |
| AD-1410877 | csgsuuugAfcAfAfGfcaaaucgugUfL96 | 2140 | asCfsacgAfuUfUfgcuuGfucfaaacgsusc | 2219 | GACGUUUGACAAGCAAAUCGUGC | 2296 |
| AD-109325 | gsusuugaCfaAfGfCfaaaucgugcuL96 | 2141 | asGfscacGfaUfUfugcuUfgUfcaaacsgsu | 2220 | ACGUUUGACAAGCAAAUCGUGCU | 2297 |
| AD-1410878 | ususugaCfaAfgGfCfAfaaucgugcuuL96 | 2142 | asAfsgcaCfgAfUfuugcUfuGfucaaascsg | 2221 | CGUUUGACAAGCAAAUCGUGCUA | 2298 |
| AD-1410927 | cscscuaaUfgUfaCfCfagucaaaugguL96 | 2143 | asCfsauuGfuAfCfAfcagucAfAfuaggsgsa | 2222 | UCCCUAAUGUACACAGUCAAUGG | 2299 |
| AD-1410928 | csusaaugUfaCfAfCfagucaaauggaL96 | 2144 | asCfscauUfgAfCfugugUfaCfauuagsgsg | 2223 | CCCUAAUGUACACAGUCAAUGGA | 2300 |
| AD-109396 | uasaauguAfcAfCfAfgucaauggauL96 | 2145 | asUfsccaUfugGfAfcguGfuAfcauuasgsg | 2224 | CCUAAUGUACACAGUCAAUGGAU | 2301 |
| AD-1410929 | asasauguacfaCfAfGfucaauggauL96 | 2146 | asAfsuccAfuUfGfacugUfgUfacauusasg | 2225 | CUAAUGUACACAGUCAAUGGAUA | 1762 |
| AD-1410994 | asusuauuCfuCfCfAfuucauucaL96 | 334 | asUfsgaaAfuGfAfauggAfgAfauaausuc | 468 | GAAUUAUUCUCCAUUCAUUUCAA | 602 |
| AD-109601 | asasagugGfaUfCfAfuaucucucuL96 | 293 | asGfsagaAfgAfUfuaugaUfcCfacuuusscsc | 427 | GGAAAGUGGAUCAUAUCUUCUCU | 561 |
| AD-1411138 | cscscaggaAfuCfUfUfaagaaaauaauL96 | 336 | asUfsauuUfucUfUfuaagAfuUfccuggsusu | 470 | AACCAGGAAUCUUAAGAAAAUAA | 604 |
| AD-1411203 | gsgsgacuaUfgCfAfCfcguaauacuL96 | 2147 | asGfsuauUfacCfAfggugCfaUfaguccscsa | 2226 | UGGGACUAUGCACCUGUAAUACC | 2302 |
| AD-1411204 | gsasacuauGfcAfCfCfuguaauaccL96 | 2148 | asGfsguaUfuAfCfaggugGfcAfuagucscsc | 2227 | GGGACUAUGCACCUGUAAUACCA | 2303 |

TABLE 8-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO: | mRNA target sequence 5' to 3' | SEQ ID NO: |
|---|---|---|---|---|---|---|
| AD-1411205 | ascsuaugCfaCfCfUfguaauaccauL96 | 2149 | asUfsgguAfuUfAfacaggUfgCfauagususc | 2228 | GGACUAUGCACCUGUAAUACCAG | 2304 |
| AD-1411206 | csusaugcAfcCfUfGfuaauaccaguL96 | 2150 | asCfsuggUfaUfUfacagGfuCfcauagsusc | 2229 | GACUAUGCACCUGUAAUACCAGC | 2305 |
| AD-109757 | gscsaccugUfuAfAfUfaccagcgaauL96 | 2151 | asUfsucgCfuGfGfuauuAfcAfggugcsasu | 2230 | AUGCACCUGUAAUACCAGCGAAU | 2306 |
| AD-1411210 | csasccugUfaAfUfAfccagcgaauuL96 | 2152 | asAfsuucGfcUfGfguauUfaCfaggugcsa | 2231 | UGCACCUGUAAUACCAGCGAAUA | 1797 |
| AD-109759 | ascscuguAfaUfAfCfcagcgauauuL96 | 2153 | asUfsauucCfgCfUfgguaUfuAfcaggusgc | 2232 | GCACCUGUAAUACCAGCGAAUAU | 2307 |
| AD-1411211 | cscsuguaAfuAfCfCfcagcgauauuL96 | 2154 | asAfsuauUfcGfCfuggaAfuUfacaggsusg | 2233 | CACCUGUAAUACCAGCGAAUAUG | 2308 |
| AD-1411212 | csusguaaUfaCfCfAfgcgauaugguL96 | 2155 | asCfscauAfuCfGfcuggUfaUfuacagsgsu | 2234 | ACCUGUAAUACCAGCGAAUAUGG | 2309 |
| AD-1411213 | ugsguaaUfaCfCfAfgGfCfgaauaugguL96 | 2156 | asCfscauAfuUfCfGfcuggUfaUfuacagsgg | 2235 | CCUGUAAUACCAGCGAAUAUGGA | 1798 |
| AD-1411214 | gsusaauaCfcAfGfCfgaauauggacuL96 | 2157 | asUfsccaUfaUfUfcgcuGfgUfauuaccsasg | 2236 | CUGUAAUACCAGCGAAUAUGGAC | 1799 |
| AD-1411215 | usasauacCfaGfCfGfaauauggacuL96 | 2158 | asGfsuccAfuAfUfucgcUfgGfuauuascsa | 2237 | UGUAAUACCAGCGAAUAUGGACA | 2310 |
| AD-1411226 | uscsagcaUfUfUfGfGfauaauuucuL96 | 337 | asAfsgaaAfuUfAfuccaAfaUfgcugasgsa | 471 | UCUCAGCAUUUGGAUAAUUUCUC | 605 |
| AD-1411342 | ascsacucAfaAfAfUfcguguucaauL96 | 340 | asUfsugaAfcAfCfgauuUfuGfagugusgsu | 474 | ACACACUCAAAAUCGUGUUCAAA | 608 |
| AD-110052 | usasaguaGfaAfCfAfucuuagaguuL96 | 295 | asAfscucUfaAfGfauguUfcCfacuuasusa | 429 | UAUAAGUGGAACAUCUUAGAGUU | 563 |
| AD-1411480 | usasacaaGfacCfCfAfuacuacaguuL96 | 342 | asAfscugUfaGfUfauggUfcUfuguuasasg | 476 | CUUAACAAGACCAUACUACAGUG | 610 |
| AD-1411743 | csasuucaUfcUfAfUfggaagagguL96 | 345 | asCfscucUfuUfCfcauaGfaUfgaaugsasg | 479 | CUCAUUCAUCUAUGGAAAGAGGC | 613 |

TABLE 8-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO | mRNA target sequence 5' to 3' | SEQ ID NO: |
|---|---|---|---|---|---|---|
| AD-110518 | ususggaaCfuUfGfGfauguuaacuuL96 | 298 | asAfsguuAfaCfAfuccaAfgUfuccaascsa | 432 | UGUUGGAACUUGGAUGUUAACUU | 566 |
| AD-1411798 | usasacuuCfcAfUfGfaauucuaguuL96 | 346 | asAfscuaGfaAfUfucauGfGfaguuasasc | 480 | GUUAACUUCCAUGAAUUCUAGUC | 614 |
| AD-1411972 | cscsgaaaCfucUfaAfUfcaugaaucuL96 | 348 | asGfsauuCfaAfUfgaugAfgUfuccggsasa | 482 | UUCCGAAACUCAUCAUUGAAUCA | 616 |
| AD-110844 | uscsaaaaCfcAfcGfAfuauaauuguuL96 | 300 | asAfscaaUfuAfUfuaucuGfuGfuuugasasg | 434 | CUUCAAACACAGAUAUAAUUGUU | 568 |
| AD-1412040 | gsusugguUfcAfAfAfuuauucuucuL96 | 350 | asGfsaagAfaUfAfuuuuGfaAfccaacsasa | 484 | UUGUUGGUUCAAAUUAUUCUUCC | 618 |
| AD-1412095 | asscsucagUfucUfcCfUfcaauucuccuL96 | 352 | asGfsgaaGfaAfUfugagAfaCfugagususc | 486 | GAACUCAGUUCUCAAUUCUUCCA | 620 |
| AD-1412163 | usascgucUfaCfUfUfucacuugguuL96 | 353 | asAfsccaAfgUfGfaaagUfaGfacguasusc | 487 | GAUACGUCUACUUUCACCUUGGUG | 621 |
| AD-111287 | asasguuaCfucUfaAfUfcuagagauuuuL96 | 301 | asAfsaauCfuUfAfgaguAfgUfacuususg | 435 | CAAAGUAACUAUCUAAGAUUUU | 569 |
| AD-1412482 | csusagaguUfuAfGfAfcauaaaucuL96 | 357 | asAfsgauUfuAfUfgucuAfaCfucuagsgsa | 491 | UCCUAGAGUUAGACAUAAAUCUC | 625 |
| AD-1412539 | ususucucAfuUfAfAfgacacgaaauL96 | 359 | asUfsuucGfuGfUfcuuaAfuGfagaaascsu | 493 | AGUUUCAUUAAGACACGAAAA | 627 |
| AD-1412582 | usgsaagcCfuAfAfcAfcacauuuucuL96 | 360 | asAfsaaaUfgUfGfuuguAfgGfcuucascsu | 494 | AGUGAAGCCUACAACACAUUUC | 628 |
| AD-1412622 | asasuccaAfuGfAfAfcaucucucuL96 | 361 | asAfsagaGfaUfGfuuucAfuUfggauususa | 495 | UAAAUCCAAUGAAACAUCUCUUC | 629 |
| AD-1412733 | uscsaaauGfcAfCfUfcuacuucaguL96 | 364 | asCfsugaAfgUfAfgagugGfcAfuuugasusc | 498 | GAUCAAAUGCACUCUACUUCAGA | 632 |
| AD-112396 | usascucuCfaAfUfGfauacuuucuL96 | 305 | asGfsaaaAfgUfAfucauUfgAfgaguasgsg | 439 | CCUACUCUCAAUGAUACUUUCU | 573 |
| AD-1413210 | csusaucaAfaGfGfAfauuuaauccuL96 | 373 | asGfsgauUfaAfAfuuccUfuUfgauagsasa | 507 | UUCUAUCAAAGGAAUUUAAUCCA | 641 |
| AD-1413286 | ascsuaugCfuGfAfAfauugauuauuL96 | 375 | asAfsuaaUfcAfAfuuucAfgCfauagscsa | 509 | UGACUAUGCUGAAAUUGAUUAUG | 643 |

TABLE 8-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO | mRNA target sequence 5' to 3' | SEQ ID NO: |
|---|---|---|---|---|---|---|
| AD-112618 | asasacagAfaGfAfAfauuauuacauL96 | 306 | asUfsguaAfuAfAfuuucUfuguuuscsc | 440 | GGAAACGAAGAAAUAUUACAU | 574 |
| AD-112760 | asgscacuUfuAfCfcaaacgugauL96 | 307 | asUfscacGfuUfUfguuaAfaAfgugcusgsu | 441 | ACAGCACUUUUACCAAACGUGAU | 575 |
| AD-1413517 | ususauccAfaGfUfUfcguuuuaaauL96 | 378 | asUfsuuaAfaAfCfgaacUfuGfgauaascsa | 512 | UGUUAUCCAAGUUCGUUUUAAAA | 646 |
| AD-1413605 | asusgcugUfuCfAfGfcccaaauagcaL96 | 379 | asGfscuaUfuUfGfgcugAfaCfagcaususa | 513 | UAAUGCUGUUCAGCCAAAUAGCA | 647 |
| AD-1413615 | usasagcgUfuAfUfAfCfcuacguauuL96 | 380 | asAfsuacGfuAfGfguauAfaCfugcuasusu | 514 | AAUAGCAGUUAUACCUACGUAUG | 648 |
| AD-113137 | gsasgagaAfuUfUfGfucuuacuauuL96 | 308 | asAfsuagUfaAfGfacaaAfuUfcucucsasu | 442 | AUGAGAGAAUUUGUCUUACUAUU | 576 |
| AD-113331 | gsascauuCfacCfGfUfUfgguucacuuuL96 | 309 | asAfsaguGfaAfCfcacgUfgAfaugucsusu | 443 | AAGACAUUCACGUGGUUCACUUU | 577 |
| AD-1413936 | csusgguuCfaUfUfUfaaaacucuuuL96 | 381 | asAfsagaGfuUfUfuaaaUfgAfaccagsgsc | 515 | GCCUGGUUCAUUUAAAACUCUUG | 649 |
| AD-113467 | gsasgcagGfgAfUfGfcaaacgccauL96 | 2159 | asUfsggcGfuUfUfgcauCfcCfugcucsusu | 2238 | GAGAGCAGGGAUGCAAACGCCAU | 2311 |
| AD-113468 | asgsgcagGfaUfGfCfaaacgccauuL96 | 2160 | asAfsuggCfgUfUfugcaUfcCfcugcucsu | 2239 | AGAGCAGGGAUGCAAACGCCAUU | 2312 |
| AD-113471 | asgsgggauGfcAfAfAfacgccauuuL96 | 2161 | asGfsaaaUfgGfCfguuuGfcAfuccscusgsc | 2240 | GCAGGGAUGCAAACGCCAUUUCU | 2313 |
| AD-113472 | gsgsggauGfcAfAfAfCfgccauuucuuL96 | 2162 | asAfsgaaAfuGfGfcguuUfgCfauccscsug | 2241 | CAGGGAUGCAAACGCCAUUUCUU | 2314 |
| AD-1414007 | gsgsgaugCfaAfAfCfGfCfccauuucuuL96 | 2163 | asAfsagaAfaUfGfGfcguuUfgCfcaucescsu | 2242 | AGGGAUGCAAACGCCAUUUCUUA | 2315 |
| AD-113474 | gsasugcaAfaCfGfCfcauuucuauL96 | 2164 | asUfsaagAfAfAfUfggcGfuUfgcaucscsc | 2243 | GGGAUGCAAACGCCAUUUCUAU | 2316 |
| AD-1414008 | asusgcaaAfcGfCfCfauuucuauuL96 | 2165 | asAfsuaaGfaAfAfuggcGfuUfugcauscsc | 2244 | GGAUGCAAACGCCAUUUCUAUC | 1926 |

TABLE 8-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO | mRNA target sequence 5' to 3' | SEQ ID NO: |
|---|---|---|---|---|---|---|
| AD-1414009 | usgscaaaCfgCfCfAfuuucuuaucuL96 | 382 | asGfsauaAfgAfAfauggCfgUfuugcasusc | 2166 | GAUGCAAACGCCAUUUCUUAUCA | 650 |
| AD-113477 | gscsaaacGfcCfAfUfuucuuaucauL96 | 2165 | asUfsgauAfaGfAfaaugGfcGfuuugcsasu | 2166 | AUGCAAACGCCAUUUCUUAUCAU | 1927 |
| AD-1414010 | csasaaacgCfcAfUfUfucuuaucauuL96 | 2166 | aaAfsugaUfaAfGfaaauGfcGfuuugcsca | 2167 | UGCAAACGCCAUUUCUUAUCAUG | 2317 |
| AD-1414011 | asasaacgcCfaUfUfUfcuuaucaugaL96 | 2167 | asCfsaugAfuAfAfgaaaUfgGfcguuusgsc | 2168 | GCAAACGCCAUUUCUUAUCAUGG | 2318 |
| AD-1414012 | asasacgcAfuUfUfCfuuaucauggULL96 | 2168 | asCfscauGfaUfAfagaaAfuGfcguuusug | 2169 | CAAACGCCAUUUCUUAUCAUGGA | 2319 |
| AD-1414013 | ascsgccaUfuUfcUfCfuuaucauggaUL96 | 2169 | asUfsccaUfgAfUfaagaAfuUfggcgusus | 2170 | AAACGCCAUUUCUUAUCAUGGAC | 2320 |
| AD-1414014 | csgsccauUfuCfUfUfaucauggacuL96 | 2170 | asGfsuccAfuGfAfuaagaAfaAfuggcgsusu | 2171 | AACGCCAUUUCUUAUCAUGGACA | 2321 |
| AD-1414044 | asusgggaCfuAfAfGfcacugguauULL96 | 2171 | asAfsuaCfaGfUfgcuuAfgUfcccaususg | 2172 | CAAUGGGACUAAGCACUGGUAUC | 2322 |
| AD-1414045 | usgsgggaCfuAfAfGfCfacugguaucaLL96 | 2172 | asGfsauaCfcAfGfugcuUfaGfucccasusu | 2173 | AAUGGGACUAAGCACUGGUAUCA | 2323 |
| AD-113522 | gsgsgacuAfaGfCfAfcugguaucauL96 | 2173 | asUfsgauAfcCfAfgugcUfuAfgucccsasu | 2174 | AUGGGACUAAGCACUGGUAUCAU | 2324 |
| AD-1414046 | gsgsgacuaAfgCfAfCfugguaucauuL96 | 2174 | asAfsugaUfaCfCfagugCfuUfaguccscsa | 2175 | UGGGACUAAGCACUGGUAUCAUA | 2325 |
| AD-113526 | csusaagcAfcUfGfGfuaucauaucuL96 | 2175 | asGfsauaUfgAfUfaccaGfufcuuagsusc | 2176 | GACUAAGCACUGGUAUCAUAUCU | 2326 |
| AD-1414048 | usasaagcaCfugGfGfuaucauaucuL96 | 2176 | asAfsgauAfugGfauaccAfgUfgcuuasgsu | 2177 | ACUAAGCACUGGUAUCAUAUCUG | 1930 |
| AD-1414049 | asasagcacUfgGfUfAfucauaucuguL96 | 2177 | asCfsagaUfaUfGfauacCfaGfugcuusasg | 2178 | CUAAGCACUGGUAUCAUAUCUGA | 2327 |
| AD-113529 | asgscacuGfgUfAfUfcauaucugauL96 | 2178 | asUfscagAfuAfUfgauaCfcAfgugcusua | 2179 | UAAGCACUGGUAUCAUAUCUGAU | 2328 |
| AD-113530 | gscsacugGfuAfUfCfauaucgauuL96 | 2179 | asAfsucaGfaUfAfugauaUfcCfagugcsusu | 2180 | AAGCACUGGUAUCAUAUCUGAUU | 2329 |

TABLE 8-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO | mRNA target sequence 5' to 3' | SEQ ID NO: |
|---|---|---|---|---|---|---|
| AD-1414050 | csascuggUfaUfCfAfuaucugauuuL96 | 2181 | asAfsaucAfgAfUfaugauAfaCfcagugscsu | 2260 | AGCACUGGUAUCAUAUCUGAUUC | 2330 |
| AD-1414053 | usgsguauCfaUfAfUfcugauucacuL96 | 2182 | asGfsugaAfuCfAfgauaUfgAfuaccasgsu | 2261 | ACUGGUAUCAUAUCUGAUUCACA | 2331 |
| AD-1414074 | uscssagaGfuUfCfUfgggvuacuguL96 | 384 | asCfsaguAfaCfCfcagaAfaCfucugasasg | 518 | CUUCAGAGUUUCUGGGUUACUGG | 652 |
| AD-1414139 | aggsaauuUfgCfCfUfcuaaccuuuL96 | 385 | asAfsaggUfuUfAfgaggCfaAfauucusgsc | 519 | GCAGAAUUGCCUCUAAACCUUG | 653 |
| AD-1414213 | csusgaagUfcCfUfGfcuauaccacuL96 | 2183 | asGfsuggUfaUfAfgcagGfaCfuucagsgsu | 2262 | ACCUGAAGUCCUGUAUACCACA | 2332 |
| AD-1414218 | csusgcuaUfaCfCfAfcagaguucuL96 | 1416 | asAfsgaaCfuCfUfguggUfaUfagcagsgsa | 2263 | UCCUGCUAUACCACAGAGUUCUA | 1939 |
| AD-1414219 | usgscuauAfccCfAfcAfCfagagucuauL96 | 2184 | asUfsagaAfaCfUfcugugGfuAfuagcasgsg | 2264 | CCUGCUAUACCACAGAGUUCUAU | 2333 |
| AD-1414219 | gscsuauaCfcAfCfAfgagucuauaL96 | 2185 | asAfsuagAfaCfUfcugugGfUfauagcsasg | 2265 | CUGCUAUACCACAGAGUUCUAUG | 2334 |
| AD-113751 | csusauaCfaCfAfGfagucuaugtuL96 | 2186 | asCfsauaGfaAfCfucugUfgGfuauagscsa | 2266 | UGCUAUACCACAGAGUUCUAUGU | 2335 |
| AD-1414220 | usasuaccAfcAfGfAfaguucuauguL96 | 2187 | asAfscauAfgAfAfcucuGfuGfguauasgsc | 2267 | GCUAUACCACAGAGUUCUAUGUA | 1940 |
| AD-1414221 | asusaccaCfaGfAfGfuucuauguaL96 | 2188 | asUfsacaUfaGfAfacucUfgUfgguausasg | 2268 | CUAUACCACAGAGUUCUAUGUAG | 2336 |
| AD-1414222 | usasccagCfaGfUfCfucuauguagcL96 | 2189 | asCfssuacAfuAfGfaacuCfuGfugguasusa | 2269 | UAUACCACAGAGUUCUAUGUAGC | 1941 |
| AD-113757 | asscsacaGfaGfUfUfcuauguagcuL96 | 2190 | asGfscuaCfaUfAfgaacUfcUfgugusasu | 2270 | AUACCACAGAGUUCUAUGUAGCU | 2337 |
| AD-113758 | cscsacagAfgUfUfCfuaugguagcuuL96 | 1419 | asAfsgcuAfcAfUfagaaCfucfugugsusa | 2271 | UACCACAGAGUUCUAUGUAGCUU | 1942 |
| AD-1414223 | csascagaGfuUfCfUfaugtagcuuuL96 | 2191 | asAfsagcUfaCfAfuagaAfcUfcugugsgsu | 2272 | ACCACAGAGUUCUAUGUAGCUUA | 1943 |

TABLE 8-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO | mRNA target sequence 5' to 3' | SEQ ID NO: |
|---|---|---|---|---|---|---|
| AD-1414226 | asgsaguuCfuAfUfGfuagcuuacauL96 | 1421 | asUfsguaAfgCfUfacauAfgAfacucusgsu | 2273 | ACAGAGUUCUAUGUAGCUUACAG | 1944 |
| AD-113763 | gsasguucUfaUfGfGfuagcuuacagsuL96 | 2192 | asCfsuguAfaGfCfuacaUfaGfaacucsusg | 2274 | CAGAGUUCUAUGUAGCUUACAGU | 2338 |
| AD-113764 | agsguucAfuGfUfAfgcuuacagsuuL96 | 2193 | asAfscugUfaAfGfcuacAfuAfgaacucscsu | 2275 | AGAGUUCUAUGUAGCUUACAGUU | 1945 |
| AD-1414229 | uscsuaugUfaGfCfUfuacaguuccuL96 | 1423 | asGfsgaaCfuGfUfaagcUfaCfauagasasc | 2276 | GUUCUAUGUAGCUUACAGUUCCA | 1946 |
| AD-1414230 | csusaugUfgCfUfUfacaguccauL96 | 2194 | asUfsggaAfcUfGfuagcUfuAfcauagsasa | 2277 | UUCUAUGUAGCUUACAGUCCAA | 2339 |
| AD-1414231 | usasuguaGfcUfUfAfcaguccaauL96 | 2195 | asUfsuggAfacUfUfguaaGfcUfacauasgsa | 2278 | UCUAUGUAGCUUACAGUCCAAC | 2340 |
| AD-1414235 | usasgcuuAfcAfGfUfuccaccaguL96 | 2196 | asCfsuggUfuGfGfaacuGfuAfagcuascsa | 2279 | UGUAGCUUACAGUUCCAACCAGA | 2341 |
| AD-113275 | gsasaugUfaUfGfUfauuaaugsuL96 | 387 | asCfsauuAfaAfafucaUfcAfcauucscsu | 521 | AGGAAUGUAUUAUGG | 655 |
| AD-113890 | ascscuauUfgUfGfGfCfuagauauauuL96 | 2197 | asUfsauaUfaUfAfgcuaCfaCfAfuaggusgsg | 2280 | CCACCUAUUGUGGCUAGAUAUAU | 2342 |
| AD-113891 | cscsuauUfgUfGfGfCfuagauauauuL96 | 2198 | asAfsuauAfucUfUfagccAfcAfauagusug | 2281 | CACCUAUUGUGGCUAGAUAUAUU | 2343 |
| AD-1414321 | csusauugUfgGfCfUfagauauauuuL96 | 2199 | asAfsauaUfaUfCfuagcCfaCfauaagsgsu | 2282 | ACCUAUUGUGGCUAGAUAUAUUA | 2344 |
| AD-1414322 | usasuugUfgGfcUfAfgauauauuagL96 | 2200 | asUfsaauAfuAfUfcuagCfCfauauasgsg | 2283 | CCUAUUGUGGCUAGAUAUAUUAG | 2345 |
| AD-1414323 | asusugugGfcUfAfGfauauauuasg | 2201 | asCfsuaaUfaUfAfucuaGfcCfacaauasag | 2284 | CUAUUGUGGCUAGAUAUAUUAGG | 2346 |
| AD-1414324 | ususgugCfuUfAfGfAfuauauuaggaL96 | 2202 | asCfscuaAfuAfUfaucUfAfgCfcacaasusa | 2285 | UAUUGUGGCUAGAUAUAUUAGGA | 2347 |
| AD-113896 | usgsuggCfuAfGfAfUfuaauaggsauL96 | 2203 | asUfsccuUfaUfAfauCfUfaGfccacasasu | 2286 | AUUGUGGCUAGAUAUUAGGAU | 2348 |
| AD-1414325 | gsusggcuAfgAfUfUfAfuauuaggauuL96 | 2204 | asAfsuccUfaAfUfAfUfauauCfuAfgccacsasa | 2287 | UUGUGGCUAGAUAUAUAGGAUC |  |

TABLE 8-continued

Modified Sense and Antisense Strand Sequences of Coagulation Factor V dsRNA Agents

| Duplex Name | Sense Sequence 5' to 3' | SEQ ID NO: | Antisense Sequence 5' to 3' | SEQ ID NO | mRNA target sequence 5' to 3' | SEQ ID NO: |
|---|---|---|---|---|---|---|
| AD-1414326 | gsgscuagAfuAfUfAfuuaggaucuuL96 | 1431 | asAfsgauCfcUfAfauauAfuCfuagccsasc | 2288 | GUGGCUAGAUAUAUUAGGAUCUC | 1954 |
| AD-113900 | gscsuagaUfaAfUfUfuaggaucucuL96 | 2205 | asGfsagaUfcCfUfaauaUfcuagcscsa | 2289 | UGGCUAGAUAUAUUAGAGAUCUCU | 2349 |
| AD-1414544 | cscsucugAfaAfUfGfuauguaaaguL96 | 391 | asCfsuuuAfcAfUfacauUfcfagaggsasc | 525 | GUCCUCUGAAAUGUAUGUAAAGA | 659 |
| AD-114455 | csusguguUfaAfAfUfguuaacaguuL96 | 310 | asAfscugUfuAfAfcauuUfaAfcacagscsg | 444 | CGCUGUGUAAAUGUUAACAGUU | 578 |
| AD-114469 | ascsaguuUfuCfCfAfcuauuucucuL96 | 311 | asGfsagaAfaUfAfguggAfaAfacugususa | 445 | UAACAGUUUCCACUAUUUCUCU | 579 |

TABLE 9

Coagulation Factor V Single Dose Screens in Primary Human Hepatocytes

| Duplex | 100 nM Avg % messange remaining | SD | 10 nM Avg % messange remaining | SD | 1 nM Avg % messange remaining | SD |
|---|---|---|---|---|---|---|
| AD-1465906.1 | 29.83 | 4.34 | 26.18 | 3.53 | 54.99 | 18.44 |
| AD-1465908.1 | 59.18 | 12.74 | 74.88 | 11.96 | 74.90 | 17.45 |
| AD-1465913.1 | 47.70 | 1.65 | 69.93 | 11.45 | 129.22 | 44.45 |
| AD-1465918.1 | 35.23 | 4.46 | 65.53 | 10.38 | 93.25 | 25.68 |
| AD-1465922.1 | 35.52 | 2.44 | 94.25 | 2.29 | 87.46 | 14.20 |
| AD-1465928.1 | 60.78 | 12.66 | 122.14 | 35.25 | 100.35 | 16.69 |
| AD-1465932.1 | 41.79 | 11.74 | 64.38 | 3.83 | 81.63 | 18.56 |
| AD-1465937.1 | 48.83 | 6.44 | 124.91 | 13.19 | 110.81 | 14.87 |
| AD-1465946.1 | 52.64 | 11.24 | 62.37 | 6.03 | 93.29 | 9.13 |
| AD-1465951.1 | 40.09 | 8.54 | 99.58 | 21.83 | 104.92 | 22.08 |
| AD-1465957.1 | 35.57 | 12.19 | 79.64 | 20.36 | 127.03 | 17.98 |
| AD-1465960.1 | 30.07 | 2.92 | 56.45 | 5.43 | 92.21 | 3.19 |
| AD-1465968.1 | 37.66 | 8.80 | 56.38 | 14.13 | 64.06 | 14.04 |
| AD-1465973.1 | 48.33 | 2.94 | 52.38 | 16.25 | 113.50 | 17.56 |
| AD-1465984.1 | 29.17 | 2.48 | 31.73 | 8.23 | 63.52 | 11.59 |
| AD-1466007.1 | 21.09 | 6.59 | 47.97 | 9.50 | 50.25 | 11.81 |
| AD-1466012.1 | 37.54 | 14.69 | 71.09 | 10.42 | 52.06 | 14.46 |
| AD-1466022.1 | 38.58 | 4.19 | 69.33 | 25.75 | 84.13 | 23.97 |
| AD-1466029.1 | 35.09 | 10.37 | 60.88 | 11.96 | 79.29 | 15.81 |
| AD-1466031.1 | 37.70 | 7.26 | 50.53 | 12.10 | 72.60 | 19.92 |
| AD-1466034.1 | 41.13 | 10.35 | 71.69 | 10.74 | 99.39 | 5.05 |
| AD-1466036.1 | 29.61 | 11.15 | 32.21 | 2.39 | 64.99 | 4.40 |
| AD-1466036.2 | 25.53 | 2.03 | 37.03 | 9.65 | 44.28 | 13.73 |
| AD-1466036.3 | 33.97 | 10.46 | 38.77 | 13.12 | 70.11 | 14.74 |
| AD-1466037.1 | 19.16 | 6.27 | 28.89 | 3.80 | 51.39 | 15.96 |
| AD-1466037.2 | 22.98 | 2.00 | 41.43 | 6.68 | 57.10 | 11.24 |
| AD-1466037.3 | 32.57 | 7.57 | 53.86 | 17.13 | 63.67 | 13.55 |
| AD-1466039.1 | 42.09 | 5.62 | 62.04 | 7.76 | 71.60 | 16.01 |
| AD-1466040.1 | 24.20 | 4.49 | 44.43 | 6.41 | 62.34 | 14.17 |
| AD-1466050.1 | 54.83 | 10.50 | 64.87 | 14.11 | 80.99 | 11.86 |
| AD-1466052.1 | 64.33 | 10.60 | 94.49 | 14.74 | 113.30 | 18.42 |
| AD-1466053.1 | 32.55 | 2.44 | 63.88 | 12.42 | 85.39 | 13.49 |
| AD-1466059.1 | 48.05 | 12.26 | 76.29 | 13.85 | 73.54 | 19.56 |
| AD-1466066.1 | 35.30 | 4.41 | 42.33 | 4.75 | 78.36 | 21.73 |
| AD-1466070.1 | 19.87 | 2.26 | 44.38 | 12.25 | 91.86 | 24.54 |
| AD-1466078.1 | 20.58 | 5.99 | 67.33 | 18.33 | 56.91 | 18.27 |
| AD-1466080.1 | 31.56 | 7.92 | 67.18 | 7.70 | 66.45 | 17.98 |
| AD-1466082.1 | 36.38 | 11.56 | 74.65 | 19.53 | 71.90 | 13.54 |
| AD-1466083.1 | 26.85 | 6.10 | 55.34 | 8.38 | 64.35 | 11.44 |
| AD-1466085.1 | 61.43 | 10.38 | 60.17 | 8.76 | 80.75 | 3.17 |
| AD-1466094.1 | 45.33 | 13.58 | 109.63 | 12.33 | 70.65 | 11.24 |
| AD-1466098.1 | 57.19 | 11.12 | 112.82 | 21.23 | 70.86 | 10.04 |
| AD-1466099.1 | 49.92 | 8.48 | 61.47 | 0.30 | 76.06 | 14.15 |
| AD-1466100.1 | 66.18 | 17.53 | 64.33 | 18.17 | 47.91 | 3.99 |
| AD-1466101.1 | 72.61 | 3.20 | 135.09 | 28.96 | 90.04 | 16.67 |
| AD-1466102.1 | 68.75 | 14.03 | 126.84 | 1.24 | 86.34 | 19.49 |
| AD-1466104.1 | 63.05 | 11.55 | 135.98 | 16.62 | 83.59 | 14.12 |
| AD-1466109.1 | 56.62 | 7.50 | 77.86 | 23.34 | 86.34 | 18.30 |
| AD-1466110.1 | 63.86 | 8.22 | 89.13 | 23.51 | 113.46 | 16.29 |
| AD-1466114.1 | 29.08 | 6.64 | 68.45 | 15.00 | 64.11 | 14.88 |
| AD-1466115.1 | 68.97 | 6.59 | 98.92 | 16.08 | 96.37 | 7.44 |
| AD-1466118.1 | 41.23 | 5.82 | 66.23 | 14.57 | 85.04 | 22.51 |
| AD-1466119.1 | 47.32 | 11.21 | 88.22 | 12.61 | 116.78 | 23.53 |
| AD-1466121.1 | 35.13 | 11.94 | 53.02 | 9.03 | 92.73 | 23.97 |
| AD-1466122.1 | 44.07 | 9.59 | 78.18 | 25.79 | 100.31 | 19.93 |
| AD-1466123.1 | 54.48 | 12.25 | 70.01 | 21.25 | 122.02 | 12.65 |
| AD-1466124.1 | 43.22 | 1.78 | 75.28 | 10.07 | 82.14 | 8.08 |
| AD-1466127.1 | 52.50 | 15.95 | 75.27 | 16.90 | 94.42 | 24.31 |
| AD-1466128.1 | 49.72 | 11.36 | 83.56 | 20.77 | 103.18 | 26.19 |
| AD-1466129.1 | 40.62 | 6.09 | 48.16 | 5.32 | 103.49 | 24.33 |
| AD-1466131.1 | 46.96 | 10.34 | 65.26 | 3.05 | 123.98 | 36.06 |
| AD-1466135.1 | 64.01 | 14.24 | 40.27 | 8.20 | 111.27 | 31.75 |
| AD-1466137.1 | 48.74 | 7.02 | 55.45 | 14.68 | 127.12 | 22.68 |
| AD-1466139.1 | 36.06 | 2.25 | 64.10 | 10.32 | 84.71 | 11.45 |
| AD-1466145.1 | 30.14 | 6.29 | 56.33 | 6.06 | 77.41 | 8.71 |
| AD-1466147.1 | 30.89 | 6.23 | 38.65 | 10.28 | 90.85 | 19.90 |
| AD-1466148.1 | 27.26 | 5.11 | 65.86 | 15.30 | 88.40 | 13.79 |
| AD-1466149.1 | 29.84 | 3.30 | 48.08 | 7.86 | 75.66 | 12.50 |
| AD-1466150.1 | 51.35 | 7.03 | 62.33 | 15.96 | 65.97 | 18.51 |
| AD-1466151.1 | 24.29 | 5.94 | 48.65 | 6.55 | 98.02 | 1.92 |
| AD-1466152.1 | 26.42 | 0.89 | 30.62 | 3.44 | 102.23 | 36.11 |
| AD-1466157.1 | 25.73 | 8.82 | 51.23 | 10.09 | 102.04 | 32.17 |
| AD-1466158.1 | 35.53 | 2.75 | 67.70 | 9.65 | 94.61 | 13.71 |
| AD-1466159.1 | 33.02 | 7.52 | 52.84 | 4.51 | 120.51 | 11.21 |
| AD-1466161.1 | 28.57 | 3.09 | 30.63 | | 82.51 | 23.37 |
| AD-1465901.1 | 57.87 | 9.04 | 53.64 | 13.38 | 88.39 | 22.15 |
| AD-1465902.1 | 48.56 | 11.96 | 70.88 | 11.07 | 73.14 | 21.21 |
| AD-1465903.1 | 44.34 | 9.85 | 47.75 | 8.77 | 67.42 | 11.36 |
| AD-1465904.1 | 37.91 | 4.92 | 41.98 | 12.39 | 33.19 | 8.75 |
| AD-1465905.1 | 50.62 | 5.95 | 44.70 | 11.89 | 60.39 | 9.15 |
| AD-1465907.1 | 34.85 | 3.45 | 36.11 | 2.20 | 74.47 | 16.48 |
| AD-1465909.1 | 58.91 | 8.10 | 62.94 | 3.57 | 104.51 | 15.20 |
| AD-1465910.1 | 61.54 | 7.71 | 59.27 | 16.16 | 91.39 | 33.06 |
| AD-1465911.1 | 59.52 | 15.38 | 132.87 | 32.57 | 100.84 | 39.39 |
| AD-1465912.1 | 42.06 | 5.34 | 64.28 | 20.10 | 91.26 | 28.80 |
| AD-1465914.1 | 105.46 | 11.10 | 92.12 | 24.35 | 106.32 | 18.69 |
| AD-1465915.1 | 60.43 | 14.21 | 118.89 | 40.35 | 117.99 | 21.08 |
| AD-1465916.1 | 45.27 | 10.91 | 106.59 | 11.06 | 119.82 | 15.00 |
| AD-1465917.1 | 56.73 | 7.12 | 57.77 | 7.15 | 83.93 | 21.65 |
| AD-1465919.1 | 43.92 | 6.66 | 66.21 | 19.27 | 116.81 | 15.98 |
| AD-1465920.1 | 34.38 | 5.45 | 81.57 | 14.61 | 102.84 | 29.75 |
| AD-1465921.1 | 52.78 | 11.57 | 110.77 | 30.64 | 88.13 | 33.52 |
| AD-1465923.1 | 91.10 | 23.47 | 91.90 | 38.15 | 125.85 | 35.66 |
| AD-1465924.1 | 41.76 | 1.90 | 68.53 | 10.44 | 94.54 | 17.38 |
| AD-1465925.1 | 37.77 | 7.36 | 50.52 | 18.77 | 97.68 | 6.50 |
| AD-1465926.1 | 62.24 | 7.15 | 99.17 | 38.42 | 130.35 | 18.97 |
| AD-1465927.1 | 85.58 | 12.24 | 97.79 | 40.31 | 116.52 | 28.82 |
| AD-1465929.1 | 36.85 | 9.84 | 103.71 | 44.60 | 93.92 | 6.32 |
| AD-1465930.1 | 106.58 | 25.36 | 101.36 | 14.80 | 115.35 | 22.42 |
| AD-1465931.1 | 74.08 | 10.84 | 110.75 | 26.50 | 92.45 | 19.87 |
| AD-1465933.1 | 99.35 | 10.63 | 179.02 | 20.05 | 135.22 | 26.99 |
| AD-1465934.1 | 85.52 | 12.99 | 140.24 | 46.25 | 145.52 | 25.19 |
| AD-1465935.1 | 86.84 | 19.96 | 150.01 | 35.71 | 163.34 | 19.15 |
| AD-1465936.1 | 88.64 | 13.40 | 162.30 | 34.76 | 156.28 | 25.44 |
| AD-1465938.1 | 38.79 | 10.19 | 73.28 | 10.42 | 144.90 | 17.54 |
| AD-1465939.1 | 73.88 | 4.07 | 85.75 | 19.22 | 101.88 | 24.06 |
| AD-1465940.1 | 78.26 | 20.95 | 112.58 | 21.71 | 129.16 | 38.03 |
| AD-1465941.1 | 54.44 | 15.96 | 123.89 | 9.08 | 121.39 | 14.29 |
| AD-1465942.1 | 79.95 | 11.45 | 137.88 | 17.29 | 132.23 | 45.30 |
| AD-1465943.1 | 75.70 | 6.40 | 115.27 | 20.52 | 162.27 | 43.22 |
| AD-1465944.1 | 68.77 | 4.05 | 118.76 | 19.53 | 127.42 | 35.67 |
| AD-1465945.1 | 57.12 | 16.44 | 103.63 | 24.90 | 115.73 | 33.37 |
| AD-1465947.1 | 86.40 | 25.59 | 126.21 | 20.04 | 123.51 | 11.25 |
| AD-1465948.1 | 43.10 | 10.20 | 98.00 | 22.83 | 103.47 | 19.59 |
| AD-1465949.1 | 53.60 | 6.86 | 70.00 | 13.31 | 112.30 | 7.85 |
| AD-1465950.1 | 116.16 | 31.53 | 147.58 | 22.51 | 104.47 | 7.33 |
| AD-1465952.1 | 70.70 | 16.02 | 95.96 | 13.24 | 109.50 | 4.85 |
| AD-1465953.1 | 37.01 | 11.62 | 68.81 | 9.98 | 95.21 | 18.03 |
| AD-1465954.1 | 33.97 | 4.72 | 42.53 | 3.83 | 74.95 | 6.30 |
| AD-1465955.1 | 63.93 | 12.79 | 54.90 | 7.80 | 99.36 | 37.08 |
| AD-1465956.1 | 59.44 | 6.11 | 86.80 | 11.20 | 120.03 | 36.59 |
| AD-1465958.1 | 40.12 | 4.18 | 65.27 | 11.85 | 100.13 | 21.77 |
| AD-1465959.1 | 48.70 | 11.56 | 83.42 | 15.03 | 101.42 | 7.48 |
| AD-1465961.1 | 78.95 | 22.73 | 87.27 | 8.89 | 104.09 | 16.54 |
| AD-1465962.1 | 83.70 | 11.84 | 86.95 | 7.94 | 103.75 | 16.84 |
| AD-1465963.1 | 67.50 | 10.82 | 86.53 | 6.10 | 119.68 | 27.60 |
| AD-1465964.1 | 59.74 | 10.20 | 98.07 | 20.04 | 99.23 | 16.27 |
| AD-1465965.1 | 113.61 | 11.17 | 117.85 | 19.19 | 108.54 | 31.57 |
| AD-1465966.1 | 64.91 | 7.73 | 65.19 | 12.61 | 107.27 | 11.60 |
| AD-1465967.1 | 41.57 | 9.28 | 51.46 | 13.83 | 100.10 | 3.83 |
| AD-1465969.1 | 50.71 | 8.91 | 64.40 | 13.47 | 72.75 | 10.06 |
| AD-1465970.1 | 81.09 | 11.19 | 52.52 | 9.13 | 70.49 | 5.26 |
| AD-1465971.1 | 27.45 | 6.04 | 29.49 | 3.75 | 62.10 | 13.56 |
| AD-1465972.1 | 71.55 | 12.55 | 54.61 | 7.95 | 102.37 | 16.29 |
| AD-1465974.1 | 44.84 | 8.01 | 63.89 | 17.20 | 93.46 | 23.95 |
| AD-1465975.1 | 41.96 | 3.12 | 53.23 | 11.24 | 74.50 | 17.09 |
| AD-1465976.1 | 48.14 | 8.42 | 61.24 | 6.02 | 85.16 | 11.99 |
| AD-1465977.1 | 33.43 | 4.92 | 45.13 | 5.79 | 62.44 | 14.14 |
| AD-1465978.1 | 59.62 | 7.77 | 58.25 | 6.39 | 75.72 | 9.49 |
| AD-1465979.1 | 71.02 | 11.11 | 62.45 | 7.83 | 89.18 | 10.38 |
| AD-1465980.1 | 59.01 | 8.17 | 66.45 | 9.74 | 72.88 | 5.97 |
| AD-1465981.1 | 60.22 | 9.89 | 85.34 | 11.41 | 88.80 | 4.48 |

TABLE 9-continued

Coagulation Factor V Single Dose Screens in Primary Human Hepatocytes

| Duplex | 100 nM Avg % messange remaining | SD | 10 nM Avg % messange remaining | SD | 1 nM Avg % messange remaining | SD |
|---|---|---|---|---|---|---|
| AD-1465982.1 | 54.81 | 11.89 | 53.42 | 11.85 | 87.46 | 14.50 |
| AD-1465983.1 | 45.97 | 4.25 | 56.23 | 10.22 | 82.52 | 11.05 |
| AD-1465985.1 | 47.12 | 7.15 | 35.50 | 7.84 | 51.28 | 10.28 |
| AD-1465986.1 | 47.40 | 10.35 | 39.85 | 6.57 | 49.36 | 2.74 |
| AD-1465987.1 | 62.96 | 6.64 | 49.11 | 5.09 | 48.64 | 3.79 |
| AD-1465988.1 | 59.81 | 10.49 | 50.67 | 11.49 | 71.18 | 8.19 |
| AD-1465989.1 | 64.45 | 5.90 | 61.88 | 7.82 | 84.13 | 18.88 |
| AD-1465990.1 | 59.90 | 11.33 | 58.08 | 11.01 | 88.46 | 6.32 |
| AD-1465991.1 | 75.38 | 16.14 | 70.27 | 24.74 | 71.33 | 14.52 |
| AD-1465992.1 | 64.73 | 24.05 | 69.13 | 12.11 | 64.30 | 7.18 |
| AD-1465993.1 | 60.60 | 17.66 | 98.27 | 27.45 | 67.95 | 6.11 |
| AD-1465994.1 | 68.62 | 13.30 | 82.83 | 21.82 | 80.85 | 13.41 |
| AD-1465996.1 | 67.28 | 21.13 | 91.12 | 6.94 | 61.60 | 16.47 |
| AD-1465997.1 | 89.75 | 29.13 | 88.27 | 21.51 | 60.90 | 20.08 |
| AD-1465998.1 | 87.60 | 23.94 | 87.44 | 25.55 | 74.38 | 18.86 |
| AD-1465999.1 | 56.54 | 12.64 | 57.84 | 16.37 | 67.44 | 10.28 |
| AD-1466000.1 | 82.44 | 24.18 | 104.92 | 25.71 | 99.70 | 31.14 |
| AD-1466001.1 | 105.11 | 43.76 | 83.07 | 15.38 | 74.33 | 21.86 |
| AD-1466002.1 | 56.87 | 10.92 | 57.97 | 8.77 | 55.40 | 9.05 |
| AD-1466003.1 | 42.28 | 13.90 | 73.58 | 14.86 | 40.71 | |
| AD-1466004.1 | 47.70 | 18.67 | 105.81 | 30.23 | 71.40 | 20.88 |
| AD-1466005.1 | 60.76 | 13.00 | 98.19 | 29.88 | 62.92 | 12.68 |
| AD-1466006.1 | 28.82 | 11.04 | 48.39 | 4.26 | 57.30 | 17.12 |
| AD-1466008.1 | 56.29 | 22.03 | 105.21 | 41.23 | 76.33 | 27.09 |
| AD-1466009.1 | 56.96 | 24.47 | 84.33 | 32.80 | 87.94 | 19.64 |
| AD-1466010.1 | 95.51 | 15.15 | 103.78 | 11.17 | 112.01 | 9.71 |
| AD-1466011.1 | 48.01 | 12.24 | 104.28 | 26.32 | 97.24 | 19.93 |
| AD-1466013.1 | 86.65 | 36.27 | 82.60 | 26.05 | 106.36 | 14.76 |
| AD-1466014.1 | 76.11 | 31.62 | 73.81 | 20.04 | 99.35 | 20.06 |
| AD-1466015.1 | 88.60 | 6.94 | 101.65 | 28.36 | 90.70 | 25.17 |
| AD-1466016.1 | 41.80 | 6.21 | 84.88 | 10.65 | 77.06 | 11.10 |
| AD-1466017.1 | 114.13 | 21.51 | 111.35 | 7.81 | 123.33 | 31.68 |
| AD-1466018.1 | 41.91 | 14.58 | 89.62 | 15.03 | 62.42 | 8.54 |
| AD-1466019.1 | 58.32 | 16.29 | 81.23 | 1.59 | 78.71 | 24.66 |
| AD-1466020.1 | 57.28 | 15.09 | 76.81 | 15.12 | 100.96 | 15.84 |
| AD-1466021.1 | 94.35 | 36.44 | 102.55 | 34.16 | 99.28 | 10.34 |
| AD-1466023.1 | 66.44 | 2.00 | 100.54 | 31.58 | 142.84 | 31.71 |
| AD-1466024.1 | 36.59 | 2.51 | 75.40 | 15.34 | 95.78 | 14.34 |
| AD-1466025.1 | 60.70 | 16.18 | 115.36 | 12.71 | 105.95 | 18.13 |
| AD-1466026.1 | 104.06 | 24.81 | 125.42 | 7.29 | 101.77 | 30.88 |
| AD-1466027.1 | 39.35 | 5.77 | 92.58 | 31.80 | 89.93 | 17.29 |
| AD-1466028.1 | 104.65 | 22.43 | 66.19 | 25.31 | 114.29 | 36.62 |
| AD-1466030.1 | 64.67 | 12.81 | 79.17 | 21.83 | 81.64 | 21.69 |
| AD-1466032.1 | 45.24 | 17.23 | 54.29 | 13.42 | 76.83 | 21.77 |
| AD-1466033.1 | 101.69 | 43.70 | 98.93 | 11.01 | 105.73 | 31.15 |
| AD-1466035.1 | 73.47 | 18.47 | 71.67 | 25.03 | 78.26 | 6.28 |
| AD-1466038.1 | 54.56 | 21.49 | 58.15 | 12.05 | 63.76 | 20.55 |
| AD-1466038.2 | 39.16 | 10.66 | 63.09 | 11.25 | 74.43 | 2.92 |
| AD-1466041.1 | 83.08 | 34.14 | 78.60 | 18.18 | 106.28 | 34.28 |
| AD-1466042.1 | 30.88 | 3.77 | 57.64 | 16.36 | 79.82 | 22.98 |
| AD-1466043.1 | 75.44 | 24.75 | 82.03 | 14.68 | 96.69 | 5.38 |
| AD-1466044.1 | 97.38 | 34.01 | 94.90 | 8.54 | 85.34 | 25.08 |
| AD-1466045.1 | 84.99 | 15.95 | 105.86 | 17.24 | 128.01 | 35.31 |
| AD-1466046.1 | 31.62 | 6.34 | 53.62 | 20.02 | 63.14 | 8.80 |
| AD-1466047.1 | 81.68 | 11.74 | 95.14 | 14.68 | 93.03 | 12.69 |
| AD-1466048.1 | 101.41 | 3.69 | 79.51 | 26.36 | 96.47 | 16.49 |
| AD-1466049.1 | 42.71 | 6.67 | 34.75 | 4.16 | 74.14 | 18.97 |
| AD-1466051.1 | 67.30 | 12.16 | 81.93 | 28.58 | 65.43 | 8.43 |
| AD-1466054.1 | 47.15 | 10.50 | 55.95 | 18.32 | 65.02 | 10.28 |
| AD-1466055.1 | 40.78 | 7.93 | 47.75 | 11.42 | 71.83 | 13.32 |
| AD-1466056.1 | 82.16 | 5.10 | 68.00 | 16.82 | 70.89 | 1.69 |
| AD-1466057.1 | 43.73 | 2.64 | 58.47 | 13.65 | 75.99 | 2.30 |
| AD-1466058.1 | 67.88 | 12.93 | 48.60 | 13.63 | 82.28 | 16.65 |
| AD-1466060.1 | 46.93 | 8.22 | 84.13 | 6.62 | 98.85 | 18.70 |
| AD-1466061.1 | 37.29 | 2.34 | 59.22 | 16.11 | 82.67 | 19.04 |
| AD-1466062.1 | 42.42 | 8.99 | 45.53 | 12.99 | 82.34 | 24.16 |
| AD-1466063.1 | 36.92 | 4.46 | 43.96 | 5.72 | 68.18 | 11.18 |
| AD-1466064.1 | 50.47 | 2.67 | 56.79 | 4.95 | 55.87 | 6.39 |
| AD-1466065.1 | 56.87 | 6.13 | 44.29 | 0.65 | 72.16 | 15.36 |
| AD-1466067.1 | 80.41 | 3.64 | 87.92 | 45.06 | 89.46 | 10.80 |
| AD-1466068.1 | 34.25 | 5.13 | 53.77 | 9.75 | 72.16 | 10.06 |
| AD-1466069.1 | 26.35 | 5.80 | 58.83 | 14.76 | 53.01 | 11.09 |
| AD-1466071.1 | 58.38 | 12.97 | 69.88 | 8.08 | 80.06 | 22.67 |
| AD-1466072.1 | 49.39 | 15.05 | 59.21 | 11.28 | 77.01 | 20.01 |
| AD-1466073.1 | 43.42 | 10.64 | 68.96 | 15.38 | 75.63 | 19.26 |
| AD-1466074.1 | 43.52 | 14.32 | 74.41 | 24.01 | 104.67 | 14.16 |
| AD-1466075.1 | 40.34 | 4.13 | 57.67 | 15.37 | 103.19 | 25.57 |
| AD-1466076.1 | 68.93 | 6.16 | 82.38 | 20.38 | 62.90 | 6.19 |
| AD-1466077.1 | 40.23 | 5.52 | 84.02 | 10.68 | 65.11 | |
| AD-1466079.1 | 24.56 | 0.48 | 93.85 | 27.49 | 60.02 | 4.02 |
| AD-1466081.1 | 28.87 | 5.52 | 68.78 | 8.22 | 50.99 | 14.55 |
| AD-1466084.1 | 50.97 | 8.36 | 69.55 | 9.88 | 60.83 | 9.90 |
| AD-1466086.1 | 51.13 | 14.03 | 70.54 | 15.08 | 61.27 | 10.42 |
| AD-1466087.1 | 72.70 | 25.94 | 89.10 | 12.79 | 53.69 | 11.01 |
| AD-1466088.1 | 54.34 | 4.45 | 111.52 | 10.09 | 72.95 | 2.54 |
| AD-1466089.1 | 62.03 | 15.02 | 112.74 | | 61.34 | 5.51 |
| AD-1466090.1 | 88.96 | 8.10 | 63.90 | 3.13 | 59.15 | 3.28 |
| AD-1466091.1 | 86.10 | 18.26 | 117.43 | 12.07 | 80.71 | 18.82 |
| AD-1466092.1 | 94.27 | 26.22 | 86.63 | 20.19 | 91.84 | 18.93 |
| AD-1466093.1 | 51.55 | 7.27 | 69.49 | 9.12 | 84.20 | 7.86 |
| AD-1466095.1 | 59.33 | 16.95 | 117.43 | 16.19 | 101.92 | 22.49 |
| AD-1466096.1 | 67.52 | 3.97 | 115.48 | 24.10 | 91.18 | 30.26 |
| AD-1466097.1 | 60.52 | 11.34 | 121.05 | 8.93 | 103.98 | 24.00 |
| AD-1466103.1 | 128.42 | 29.78 | 73.87 | | 122.30 | 13.53 |
| AD-1466105.1 | 137.67 | 25.36 | 76.93 | 15.05 | 88.61 | 19.32 |
| AD-1466106.1 | 45.30 | 1.18 | 73.74 | 17.90 | 61.05 | 12.02 |
| AD-1466107.1 | 126.05 | 19.72 | 105.92 | 25.37 | 92.98 | 21.53 |
| AD-1466108.1 | 101.05 | 14.68 | 110.20 | 25.25 | 106.89 | 22.80 |
| AD-1466111.1 | 85.40 | 15.20 | 119.33 | 18.31 | 117.48 | 32.63 |
| AD-1466112.1 | 98.27 | 20.07 | 108.15 | | 130.61 | 29.03 |
| AD-1466113.1 | 56.68 | 15.37 | 90.17 | 21.81 | 87.08 | 20.81 |
| AD-1466116.1 | 72.73 | 19.52 | 108.86 | 17.51 | 111.94 | 17.51 |
| AD-1466117.1 | 53.48 | 21.90 | 106.25 | 17.80 | 68.87 | 14.41 |
| AD-1466120.1 | 68.55 | 12.11 | 71.46 | 13.06 | 126.78 | 19.42 |
| AD-1466125.1 | 58.06 | 11.60 | 127.17 | 18.95 | 88.42 | 21.93 |
| AD-1466126.1 | 87.08 | 19.79 | 85.32 | 22.55 | 104.98 | 14.78 |
| AD-1466130.1 | 75.72 | 15.95 | 85.62 | 16.45 | 102.83 | 19.26 |
| AD-1466132.1 | 68.29 | 5.25 | 83.42 | 14.04 | 88.45 | 19.49 |
| AD-1466133.1 | 124.22 | 16.04 | 87.72 | 25.76 | 118.84 | 22.29 |
| AD-1466134.1 | 122.00 | 18.11 | 135.48 | 9.25 | 114.08 | 23.01 |
| AD-1466136.1 | 64.94 | 14.73 | 102.40 | 13.36 | 137.35 | 20.92 |
| AD-1466138.1 | 52.11 | 6.59 | 85.51 | 26.78 | 117.79 | 32.30 |
| AD-1466140.1 | 56.37 | 4.76 | 84.55 | 13.11 | 101.13 | 24.61 |
| AD-1466141.1 | 43.17 | 3.72 | 68.32 | 15.93 | 91.57 | 19.50 |
| AD-1466142.1 | 37.91 | 0.40 | 55.80 | 15.75 | 90.41 | 14.67 |
| AD-1466143.1 | 49.82 | 2.12 | 41.70 | 8.52 | 84.60 | 12.40 |
| AD-1466144.1 | 31.90 | 5.95 | 41.75 | 10.52 | 85.26 | 5.85 |
| AD-1466146.1 | 56.26 | 11.10 | 70.57 | 7.60 | 86.64 | 5.46 |
| AD-1466153.1 | 43.97 | 5.29 | 64.27 | 17.14 | 78.55 | 21.81 |
| AD-1466154.1 | 38.09 | 8.31 | 46.35 | 9.11 | 108.60 | 28.64 |
| AD-1466155.1 | 55.36 | 6.79 | 59.63 | 9.90 | 87.88 | 21.13 |
| AD-1466156.1 | 70.04 | 14.74 | 92.49 | 4.18 | 102.37 | 24.04 |
| AD-1466160.1 | 27.56 | 1.45 | 44.01 | 3.35 | 89.01 | 22.70 |
| AD-1466162.1 | 27.16 | 2.05 | 47.00 | 6.89 | 108.14 | 13.91 |
| AD-1466163.1 | 59.34 | 8.87 | 89.12 | 17.16 | 116.26 | 16.86 |
| AD-1466164.1 | 62.57 | 8.31 | 70.35 | 13.88 | 97.88 | 12.84 |
| AD-1466165.1 | 43.49 | 5.88 | 56.26 | 15.42 | 106.92 | 37.94 |

Example 4. Additional Duplexes Targeting Coagulation Factor V

Additional agents targeting coagulation factor V gene were designed using custom R and Python scripts and synthesized as described above.

A detailed list of the unmodified complement coagulation factor V sense and antisense strand nucleotide sequences is shown in Table 10. A detailed list of the modified coagulation factor V sense and antisense strand nucleotide sequences is shown in Table 11.

For transfections, 7.5 µl of Opti-MEM plus 0.1 µl of Lipofectamine RNAiMax per well (Invitrogen, Carlsbad CA. cat #13778-150) was added to 2.5 µl of each siRNA duplex to an individual well in a 384-well plate. The mixture was then incubated at room temperature for 15 minutes. Forty µl of complete growth media without antibiotic containing ~1.5×10$^4$ cells was then added to the siRNA mixture. Cells are incubated for 24 hours prior to RNA purification. Single dose experiments were performed at 10 nM, 1 nM, and 0.1 nM final duplex concentration.

Total RNA isolation was performed using DYNABEADS. Briefly, cells were lysed in 10 µl of Lysis/Binding Buffer containing 3 µL of beads per well were mixed for 10 minutes on an electrostatic shaker. The washing steps were automated on a Biotek EL406, using a magnetic plate support. Beads were washed (in 3 µL) once in Buffer A, once in Buffer B, and twice in Buffer E, with aspiration steps in between. Following a final aspiration, complete 12 µL RT mixture was added to 5 each well, as described below.

For cDNA synthesis, a master mix of 1.5 µl 10× Buffer, 0.6 µl 10×dNTPs, 1.5 µl Random primers, 0.75 µl Reverse Transcriptase, 0.75 µl RNase inhibitor and 9.9 µl of H$_2$O per reaction was added per well. Plates were sealed, agitated for 10 minutes on an electrostatic shaker, and then incubated at 37 degrees C. for 2 hours. Following this, the plates were agitated at 80 degrees C. for 8 minutes.

RT-qPCR was performed as described above and relative fold change was calculated as described above. The results of the single dose screen of the agents in Tables 10 and 11 in primary human hepatocytes are shown in Table 12.

TABLE 10

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-110532.1 | UUAACUUCCAUGAAUUCUAGU | 792 | 2132-2152 | ACUAGAAUUCAUGGAAGUUAACA | 2425 | 2130-2152 |
| AD-110931.1 | AGAACUCAGUUCUCAAUUCUU | 2350 | 2592-2612 | AAGAAUUGAGAACUGAGUUCUUG | 2426 | 2590-2612 |
| AD-112393.1 | UCCUACUCUCAAUGAUACUUU | 2351 | 4630-4650 | AAAGUAUCAUUGAGAGUAGGAGA | 2427 | 4628-4650 |
| AD-114469.2 | ACAGUUUUCCACUAUUUCUCU | 21 | 6911-6931 | AGAGAAAUAGUGGAAAACUGUUA | 22 | 6909-6931 |
| AD-1410823.1 | CCUCACACACAUCUAUUACUU | 714 | 646-666 | AAGUAAUAGAUGUGUGUGAGGCA | 2054 | 644-666 |
| AD-1411340.1 | ACACACUCAAAAUCGUGUUCU | 2352 | 1431-1451 | AGAACACGAUUUUGAGUGUGUCU | 2428 | 1429-1451 |
| AD-1411342.2 | ACACUCAAAAUCGUGUUCAAU | 76 | 1433-1453 | AUUGAACACGAUUUUGAGUGUGU | 207 | 1431-1453 |
| AD-1411797.1 | GUUAACUUCCAUGAAUUCUAU | 2353 | 2131-2151 | AUAGAAUUCAUGGAAGUUAACAU | 2429 | 2129-2151 |
| AD-1411798.2 | UAACUUCCAUGAAUUCUAGUU | 82 | 2133-2153 | AACUAGAAUUCAUGGAAGUUAAC | 213 | 2131-2153 |
| AD-1412539.2 | UUUCUCAUUAAGACACGAAAU | 95 | 3218-3238 | AUUUCGUGUCUUAAUGAGAAACU | 226 | 3216-3238 |
| AD-1413196.1 | CUACUCUCAAUGAUACUUUUU | 2354 | 4632-4652 | AAAAAGUAUCAUUGAGAGUAGGA | 2430 | 4630-4652 |
| AD-1414748.1 | AACAGUUUUCCACUAUUUCUU | 2355 | 6910-6930 | AAGAAAUAGUGGAAAACUGUUAA | 2431 | 6908-6930 |
| AD-1452126.1 | AUAUGUCUUUCAUGAUCUUGU | 2356 | 8748-8768 | ACAAGAUCAUGAAAGACAUAUAG | 2432 | 8746-8768 |
| AD-1452209.1 | ACCAUCAAGGUUCACUUUAGU | 2357 | 434-454 | ACUAAAGUGAACCUUGAUGGUGU | 2433 | 432-454 |
| AD-1452212.1 | AUCAAGGUUCACUUUAGAAAU | 2358 | 437-457 | AUUUCUAAAGUGAACCUUGAUGG | 2434 | 435-457 |
| AD-1452985.1 | GUUUUCUAUUCACUUCAACGU | 2359 | 943-963 | ACGUUGAAGUGAAUAGAAAACAA | 2435 | 941-963 |
| AD-1453516.1 | UGUCACAUCAGUUCUACAAGU | 2360 | 1558-1578 | ACUUGUAGAACUGAUGUGACAGC | 2436 | 1556-1578 |
| AD-1453784.1 | CAUCAUGAACACUAUCAAUGU | 2361 | 1897-1917 | ACAUUGAUAGUGUUCAUGAUGUU | 2437 | 1895-1917 |
| AD-1454175.1 | GACUCAUAUGAGAUUUAUCAU | 2362 | 2216-2236 | AUGAUAAAUCUCAUAUGAGUCUU | 2438 | 2214-2236 |
| AD-1454221.1 | CUCGGAAAAUUCAUGAUUCUU | 2363 | 2262-2282 | AAGAAUCAUGAAUUUUCCGAGUU | 2439 | 2260-2282 |
| AD-1454350.1 | UCUAAUCGAGGAUUUCAACUU | 2364 | 676-696 | AAGUUGAAAUCCUCGAUUAGAUU | 2440 | 674-696 |
| AD-1454529.1 | CAAAAUCCUCAAGAAACCUUU | 2365 | 2048-2068 | AAAGGUUUCUUGAGGAUUUUGAG | 2441 | 2046-2068 |
| AD-1454534.1 | UCCUCAAGAAACCUUAGUAAU | 2366 | 2480-2500 | AUUACUAAGGUUUCUUGAGGAUU | 2442 | 2478-2500 |
| AD-1454719.1 | ACCCUUCAACAGAAUAUCAUU | 2367 | 1817-1837 | AAUGAUAUUCUGUUGAAGGGUUG | 2443 | 1815-1837 |
| AD-1454720.1 | CCCUUCAACAGAAUAUCAUUU | 2368 | 2608-2628 | AAAUGAUAUUCUGUUGAAGGGUU | 2444 | 2606-2628 |
| AD-1454911.1 | AAAUCCAAAGAAUACUUCUUU | 2369 | 9068-9088 | AAAGAAGUAUUCUUUGGAUUUGA | 2445 | 9066-9088 |
| AD-1455310.1 | AAAGACUACUCAAUCAUUCAU | 2370 | 2020-2040 | AUGAAUGAUUGAGUAGUCUUUUC | 2446 | 2018-2040 |

TABLE 10-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1455313.1 | AGACUACUCAAUCAUUCAUUU | 2371 | 2022-2042 | AAAUGAAUGAUUGAGUAGUCUUU | 2447 | 2020-2042 |
| AD-1455314.1 | GACUACUCAAUCAUUCAUUAU | 2372 | 4754-4774 | AUAAUGAAUGAUUGAGUAGUCUU | 2448 | 4752-4774 |
| AD-1455522.1 | AACACUCUCCAACAUUUCCUU | 2373 | 4614-4634 | AAGGAAAUGUUGGAGAGUGUUCC | 2449 | 4612-4634 |
| AD-1455659.1 | GAUGAAGUCAACUCUACUUUU | 2374 | 1514-1534 | AAAAGUAGAGUUGACUUCAUCUU | 2450 | 1512-1534 |
| AD-1455664.1 | AGUCAACUCUACUUUCACCUU | 2375 | 1519-1539 | AAGGUGAAAGUAGAGUUGACUUC | 2451 | 1517-1539 |
| AD-1455701.1 | GACAUUAGUCAAACAUCUUUU | 2376 | 7342-7362 | AAAAGAUGUUUGACUAAUGUCAU | 2452 | 7340-7362 |
| AD-1455771.1 | CCUUCCUCAGACUUAAAUCUU | 2377 | 3150-3170 | AAGAUUUAAGUCUGAGGAAGGGA | 2453 | 3148-3170 |
| AD-1455780.1 | UCAGACUUAAAUCUCUUUACU | 2378 | 3156-3176 | AGUAAAGAGAUUUAAGUCUGAGG | 2454 | 3154-3176 |
| AD-1455807.1 | GAAUGGAUCAAACAAUUAUU | 2379 | 7300-7320 | AAUAAUUGUUUGAUCCAAUUCUG | 2455 | 7298-7320 |
| AD-1457108.1 | AUUAGGUCAUUCAGAAACUCU | 2380 | 2351-2371 | AGAGUUUCUGAAUGACCUAAUUC | 2456 | 2349-2371 |
| AD-1457130.1 | GAAGAAGAGUACAAUCUUACU | 2381 | 2387-2407 | AGUAAGAUUGUACUCUUCUUCUU | 2457 | 2385-2407 |
| AD-1457237.1 | UUCGAACACAGAUAUAAUUGU | 2382 | 2443-2463 | ACAAUUAUAUCUGUGUUCGAAGA | 2458 | 2441-2463 |
| AD-1458307.1 | AAGCAAAUUACUGCAUCUUCU | 2383 | 6383-6403 | AGAAGAUGCAGUAAUUUGCUUGU | 2459 | 6381-6403 |
| AD-1458619.1 | UCAUUGUUGCUUCAUAAAUCU | 2384 | 3344-3364 | AGAUUUAUGAAGCAACAAUGAAU | 2460 | 3342-3364 |
| AD-1458724.1 | UAAUCAGAAUUCCUCGAAUGU | 2385 | 3445-3465 | ACAUUCGAGGAAUUCUGAUUAUG | 2461 | 3443-3465 |
| AD-1459277.1 | UCUGAAUCUAGUCAGUUAUUU | 2386 | 4544-4564 | AAAUAACUGACUAGAUUCAGAAG | 2462 | 4542-4564 |
| AD-1459922.1 | GAACUGAAUAUUCAAAAACCU | 2387 | 6820-6840 | AGGUUUUUGAAUAUUCAGUUCUA | 2463 | 6818-6840 |
| AD-1465918.3 | AUGCCUCACACACAUCUAUUU | 712 | 643-663 | AAAUAGAUGUGTGUGAGGCAUGG | 968 | 641-663 |
| AD-1465918.4 | AUGCCUCACACACAUCUAUUU | 712 | 643-663 | AAAUAGAUGUGTGUGAGGCAUGG | 968 | 641-663 |
| AD-1465919.2 | UGCCUCACACACAUCUAUUAU | 713 | 644-664 | ATAATAGAUGUGUGUGAGGCAUG | 969 | 642-664 |
| AD-1465920.2 | GCCUCACACACAUCUAUUACU | 11 | 645-665 | AGUAUAGAUGTGUGUGAGGCAU | 12 | 643-665 |
| AD-1465921.2 | CCUCACACACAUCUAUUACUU | 714 | 646-666 | AAGUAAUAGAUGUGUGUGAGGCA | 970 | 644-666 |
| AD-1465922.3 | CUCACACACAUCUAUUACUCU | 13 | 647-667 | AGAgtAAUAGAUGUGUGUGAGGC | 14 | 645-667 |
| AD-1465922.4 | CUCACACACAUCUAUUACUCU | 13 | 647-667 | AGAgtAAUAGAUGUGUGUGAGGC | 14 | 645-667 |
| AD-1465927.2 | GACGUUUGACAAGCAAAUCGU | 719 | 760-780 | ACGATUTGCUUGUCAAACGUCUU | 975 | 758-780 |
| AD-1465932.3 | AAUGUACACAGUCAAUGGAUU | 724 | 835-855 | AAUCCAUUGACUGUGUACAUUAG | 980 | 833-855 |
| AD-1465932.4 | AAUGUACACAGUCAAUGGAUU | 724 | 835-855 | AAUCCAUUGACUGUGUACAUUAG | 980 | 833-855 |
| AD-1465953.3 | GCAGGCUUACAUUGACAUUAU | 745 | 1105-1125 | AUAAUGUCAAUGUAAGCCUGCAU | 1001 | 1103-1125 |
| AD-1465954.3 | CAGGCUUACAUUGACAUUAAU | 71 | 1106-1126 | AUUAAUGUCAAUGUAAGCCUGCA | 202 | 1104-1126 |
| AD-1465960.3 | UACAUUGACAUUAAAAACUGU | 751 | 1112-1132 | ACAGTUTUUAAUGUCAAUGUAAG | 1007 | 1110-1132 |
| AD-1465968.3 | CACCUGUAAUACCAGCGAAUU | 759 | 1236-1256 | AAUUCGCUGGUAUUACAGGUGCA | 1015 | 1234-1256 |
| AD-1465968.4 | CACCUGUAAUACCAGCGAAUU | 759 | 1236-1256 | AAUUCGCUGGUAUUACAGGUGCA | 1015 | 1234-1256 |
| AD-1465969.2 | UGUAAUACCAGCGAAUAUGGU | 760 | 1240-1260 | ACCATAUCGCUGGUAUUACAGG | 1016 | 1238-1260 |
| AD-1465970.2 | GUAAUACCAGCGAAUAUGGAU | 761 | 1241-1261 | ATCCAUAUUCGCUGGUAUUACAG | 1017 | 1239-1261 |
| AD-1466053.3 | UCGGAAUUCUUGGUCCUAUUU | 113 | 5067-5087 | AAAUAGGACCAAGAAUUCCGAGA | 244 | 5065-5087 |
| AD-1466070.2 | GAGAGAAUUUGUCUUACUAUU | 46 | 5443-5463 | AAUAGUAAGACAAAUUCUCUCAU | 177 | 5441-5463 |
| AD-1466083.3 | AAAGAAGAGCUGGUACUAUGU | 871 | 5479-5499 | ACAUAGTACCAGCUCUUCUUUUC | 1127 | 5477-5499 |

TABLE 10-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1466100.4 | AUGCAAACGCCAUUUCUUAUU | 888 | 5831-5851 | AAUAAGAAAUGGCGUUUGCAUCC | 1144 | 5829-5851 |
| AD-1466100.5 | AUGCAAACGCCAUUUCUUAUU | 888 | 5831-5851 | AAUAAGAAAUGGCGUUUGCAUCC | 1144 | 5829-5851 |
| AD-1466101.2 | GCAAACGCCAUUUCUUAUCAU | 889 | 5833-5853 | ATGATAAGAAATGGCGUUUGCAU | 1145 | 5831-5853 |
| AD-1466104.3 | UAAGCACUGGUAUCAUAUCUU | 892 | 5883-5903 | AAGATATGAUACCAGUGCUUAGU | 1148 | 5881-5903 |
| AD-1466104.4 | UAAGCACUGGUAUCAUAUCUU | 892 | 5883-5903 | AAGATATGAUACCAGUGCUUAGU | 1148 | 5881-5903 |
| AD-1466114.4 | CUGCUAUACCACAGAGUUCUU | 19 | 6106-6126 | AAGAACTCUGUGGUAUAGCAGGA | 20 | 6104-6126 |
| AD-1466115.2 | UAUACCACAGAGUUCUAUGUU | 901 | 6110-6130 | AACATAGAACUCUGUGGUAUAGC | 1157 | 6108-6130 |
| AD-1466116.2 | UACCACAGAGUUCUAUGUAGU | 902 | 6112-6132 | ACUACAUAGAACUCUGUGGUAUA | 1158 | 6110-6132 |
| AD-1466118.3 | CACAGAGUUCUAUGUAGCUUU | 904 | 6115-6135 | AAAGCUACAUAGAACUCUGUGGU | 1160 | 6113-6135 |
| AD-1466119.3 | AGAGUUCUAUGUAGCUUACAU | 905 | 6118-6138 | AUGUAAGCUACAUAGAACUCUGU | 1161 | 6116-6138 |
| AD-1466120.2 | AGUUCUAUGUAGCUUACAGUU | 906 | 6120-6140 | AACUGUAAGCUACAUAGAACUCU | 1162 | 6118-6140 |
| AD-1466121.3 | UCUAUGUAGCUUACAGUUCCU | 907 | 6123-6143 | AGGAACTGUAAGCUACAUAGAAC | 1163 | 6121-6143 |
| AD-1466128.3 | CUAUUGUGGCUAGAUAUAUUU | 914 | 6249-6269 | AAAUAUAUCUAGCCACAAUAGGU | 1170 | 6247-6269 |
| AD-1466128.4 | CUAUUGUGGCUAGAUAUAUUU | 914 | 6249-6269 | AAAUAUAUCUAGCCACAAUAGGU | 1170 | 6247-6269 |
| AD-1466139.3 | UCCAUGGUGGACAAGAUUUUU | 924 | 6659-6679 | AAAAAUCUUGUCCACCAUGGAGG | 1180 | 6657-6679 |
| AD-1466151.3 | AAGAUUUUUGAAGGAAAUACU | 936 | 6671-6691 | AGUAUUUCCUUCAAAAAUCUUGU | 1192 | 6669-6691 |
| AD-1466152.3 | AGAUUUUUGAAGGAAAUACUU | 937 | 6672-6692 | AAGUAUUCCUCAAAAAUCUUG | 1193 | 6670-6692 |
| AD-1615169.1 | CCACAAACUCAAGUUUGAAUU | 60 | 291-311 | AAUUCAAACUUGAGUUUGUGGGC | 191 | 289-311 |
| AD-1615170.1 | AUCUUUCUGUAACUUCCUUUU | 61 | 309-329 | AAAAGGAAGUUACAGAAAGAUUC | 192 | 307-329 |
| AD-1615171.1 | AGUAUGAACCAUAUUUUAAGU | 15 | 348-368 | ACUUAAAAUAUGGUUCAUACUCU | 16 | 346-368 |
| AD-1615172.1 | CUACCAUUUCAGGACUUCUUU | 62 | 384-404 | AAAGAAGUCCUGAAAUGGUAGAU | 193 | 382-404 |
| AD-1615173.1 | CAUGCCUCACACACAUCUAUU | 1990 | 642-662 | AAUAGAUGUGUGUGAGGCAUGGA | 2464 | 640-662 |
| AD-1615174.1 | UCACACACAUCUAUUACUCCU | 66 | 648-668 | AGGAGUAAUAGAUGUGUGUGAGG | 197 | 646-668 |
| AD-1615175.1 | CAUCUAUUACUCCCAUGAAAU | 1991 | 655-675 | AUUCAUGGGAGUAAUAGAUGUG | 2465 | 653-675 |
| AD-1615176.1 | UCUGAUCGAGGAUUUCAACUU | 67 | 676-696 | AAGUUGAAAUCCUCGAUCAGAUU | 2466 | 674-696 |
| AD-1615177.1 | GGGACACAGAAGACGUUUGAU | 1992 | 749-769 | ATCAAACGUCUTCUGUGUCCCAC | 2467 | 747-769 |
| AD-1615178.1 | GGACACAGAAGACGUUUGACU | 1993 | 750-770 | AGUCAAACGUCUUCUGUGUCCCA | 2468 | 748-770 |
| AD-1615179.1 | GACACAGAAGACGUUUGACAU | 1994 | 751-771 | AUGUCAAACGUCUUCUGUGUCCC | 2469 | 749-771 |
| AD-1615180.1 | GAAGACGUUUGACAAGCAAAU | 717 | 757-777 | AUUUGCUUGUCAAACGUCUUCUG | 2470 | 755-777 |
| AD-1615181.1 | ACGUUUGACAAGCAAAUCGUU | 1995 | 761-781 | AACGAUUUGCUUGUCAAACGUCU | 2471 | 759-781 |
| AD-1615182.1 | CGUUUGACAAGCAAAUCGUGU | 1996 | 762-782 | ACACGAUUUGCUUGUCAAACGUC | 2472 | 760-782 |
| AD-1615183.1 | GUUUGACAAGCAAAUCGUGCU | 1997 | 763-783 | AGCACGAUUUGCUUGUCAAACGU | 2064 | 761-783 |
| AD-1615184.1 | UUUGACAAGCAAAUCGUGCUU | 1998 | 764-784 | AAGCACGAUUUGCUUGUCAAACG | 2065 | 762-784 |
| AD-1615185.1 | CCUAAUGUACACAGUCAAUGU | 1999 | 832-852 | ACAUUGACUGUGUACAUUAGGGA | 2473 | 830-852 |
| AD-1615186.1 | CUAAUGUACACAGUCAAUGGU | 2000 | 833-853 | ACCAUUGACUGTGUACAUUAGGG | 2474 | 831-853 |
| AD-1615187.1 | UAAUGUACACAGUCAAUGGAU | 2001 | 834-854 | AUCCAUUGACUGUGUACAUUAGG | 2475 | 832-854 |
| AD-1615188.1 | AUUAUUCUCCAUUCAUUUCAU | 70 | 940-960 | AUGAAAUGAAUGGAGAAUAAUUC | 2476 | 938-960 |

TABLE 10-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1615189.1 | AAAGUGGAUCAUAUCUUCUCU | 31 | 1057-1077 | AGAGAAGAUAUGAUCCACUUUCC | 162 | 1055-1077 |
| AD-1615190.1 | CCAGGAAUCUUAAGAAAAUAU | 72 | 1143-1163 | ATAUTUTCUUAAGAUUCCUGGUU | 2477 | 1141-1163 |
| AD-1615191.1 | GGACUAUGCACCUGUAAUACU | 2002 | 1228-1248 | AGUAUACAGGTGCAUAGUCCCA | 2478 | 1226-1248 |
| AD-1615192.1 | GACUAUGCACCUGUAAUACCU | 2003 | 1229-1249 | AGGUAUACAGGUGCAUAGUCCC | 2479 | 1227-1249 |
| AD-1615193.1 | ACUAUGCACCUGUAAUACCAU | 2004 | 1230-1250 | ATGGTATACAGGTGCAUAGUCC | 2480 | 1228-1250 |
| AD-1615194.1 | CUAUGCACCUGUAAUACCAGU | 2005 | 1231-1251 | ACUGGUAUUACAGGUGCAUAGUC | 2073 | 1229-1251 |
| AD-1615195.1 | GCACCUGUAAUACCAGCGAAU | 2006 | 1235-1255 | ATCGCTGGUAUACAGGUGCAU | 2481 | 1233-1255 |
| AD-1615196.1 | ACCUGUAAUACCAGCGAAUAU | 2007 | 1237-1257 | ATAUTCGCUGGUAUUACAGGUGC | 2482 | 1235-1257 |
| AD-1615197.1 | CCUGUAAUACCAGCGAAUAUU | 2008 | 1238-1258 | AAUAUCGCUGGUAUUACAGGUG | 2483 | 1236-1258 |
| AD-1615198.1 | CUGUAAUACCAGCGAAUAUGU | 2009 | 1239-1259 | ACAUAUCGCUGGUAUUACAGGU | 2484 | 1237-1259 |
| AD-1615199.1 | UAAUACCAGCGAAUAUGGACU | 2010 | 1242-1262 | AGUCCAUAUUCGCUGGUAUUACA | 2485 | 1240-1262 |
| AD-1615200.1 | UCAGCAUUUGGAUAAUUUCUU | 73 | 1276-1296 | AAGAAAUUAUCCAAAUGCUGAGA | 2486 | 1274-1296 |
| AD-1615201.1 | ACACUCAAAAUCGUGUUCAAU | 76 | 1433-1453 | ATUGAACACGAUUUUGAGUGUGU | 2487 | 1431-1453 |
| AD-1615202.1 | UAAGUGGAACAUCUUAGAGUU | 33 | 1594-1614 | AACUCUAAGAUGUUCCACUUAUA | 164 | 1592-1614 |
| AD-1615203.1 | UAACAAGACCAUACUACAGUU | 78 | 1647-1667 | AACUGUAGUAUGGUCUUGUUAAG | 209 | 1645-1667 |
| AD-1615204.1 | CAUUCAUCUAUGGAAAGAGGU | 81 | 2034-2054 | ACCUCUUUCCAUAGAUGAAUGAG | 2488 | 2032-2054 |
| AD-1615205.1 | UUGGAACUUGGAUGUUAACUU | 36 | 2118-2138 | AAGUUAACAUCCAAGUUCCAACA | 2489 | 2116-2138 |
| AD-1615206.1 | UAACUUCCAUGAAUUCUAGUU | 82 | 2133-2153 | AACUAGAAUUCAUGGAAGUUAAC | 213 | 2131-2153 |
| AD-1615207.1 | CCGAAACUCAUCAUUGAAUCU | 84 | 2362-2382 | AGAUUCAAUGAUGAGUUUCGGAA | 2490 | 2360-2382 |
| AD-1615208.1 | UCAAACACAGAUAUAAUUGUU | 38 | 2444-2464 | AACAAUUAUAUCUGUGUUUGAAG | 2491 | 2442-2464 |
| AD-1615209.1 | GUUGGUUCAAAUUAUUCUUCU | 86 | 2462-2482 | AGAAGAAUAAUUGAACCAACAA | 2492 | 2460-2482 |
| AD-1615210.1 | ACUCAGUUCUCAAUUCUUCCU | 88 | 2595-2615 | AGGAAGAAUUGAGAACUGAGUUC | 219 | 2593-2615 |
| AD-1615211.1 | UACGUCUACUUUCACUGGUU | 89 | 2685-2705 | AACCAAGUGAAAGUAGACGUAUC | 220 | 2683-2705 |
| AD-1615212.1 | AAGUAACUCAUCUAAGAUUUU | 39 | 2953-2973 | AAAATCTAGAUGAGUUACUUUG | 2493 | 2951-2973 |
| AD-1615213.1 | CUAGAGUUAGACAUAAAUCUU | 93 | 3150-3170 | AAGAUUUAUGUCUAACUCUAGGA | 2494 | 3148-3170 |
| AD-1615214.1 | UUUCUCAUUAAGACACGAAAU | 95 | 3218-3238 | ATUUCGUGUCUUAAUGAGAAACU | 2495 | 3216-3238 |
| AD-1615215.1 | UGAAGCCUACAACACAUUUUU | 96 | 3304-3324 | AAAAAUGUGUUGUAGGCUUCACU | 227 | 3302-3324 |
| AD-1615216.1 | AAUCCAAUGAAACAUCUCUUU | 97 | 3360-3380 | AAAGAGAUGUUUCAUUGGAUUUA | 2496 | 3358-3380 |
| AD-1615217.1 | UCAAAUGCACUCUACUUCAGU | 100 | 3553-3573 | ACUGAAGUAGAGUGCAUUUGAUC | 231 | 3551-3573 |
| AD-1615218.1 | UACUCUCAAUGAUACUUUUCU | 43 | 4633-4653 | AGAAAAGUAUCAUUGAGAGUAGG | 174 | 4631-4653 |
| AD-1615219.1 | CUAUCAAAGGAAUUUAAUCCU | 109 | 4652-4672 | AGGAUUAAAUUCCUUUGAUAGAA | 2497 | 4650-4672 |
| AD-1615220.1 | ACUAUGCUGAAAUUGAUUAUU | 111 | 4755-4775 | AAUAAUCAAUUUCAGCAUAGUCA | 2498 | 4753-4775 |
| AD-1615221.1 | AAACAGAAGAAAUUAUUACAU | 44 | 4876-4896 | ATGUAAUAAUUUCUUCUGUUUCC | 2499 | 4874-4896 |
| AD-1615222.1 | AGCACUUUUACCAAACGUGAU | 45 | 5021-5041 | ATCACGUUUGGUAAAAGUGCUGU | 2500 | 5019-5041 |
| AD-1615223.1 | UUAUCCAAGUUCGUUUUAAAU | 114 | 5109-5129 | ATUUAAAACGAACUUGGAUAACA | 2501 | 5107-5129 |
| AD-1615224.1 | AUGCUGUUCAGCCAAAUAGCU | 115 | 5238-5258 | AGCUAUUGGCUGAACAGCAUUA | 2502 | 5236-5258 |
| AD-1615225.1 | UAGCAGUUAUACCUACGUAUU | 116 | 5254-5274 | AAUACGUAGGUAUAACUGCUAUU | 2503 | 5252-5274 |

TABLE 10-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1615226.1 | GACAUUCACGUGGUUCACUUU | 47 | 5657-5677 | AAAGTGAACCACGTGAATGUCUU | 2504 | 5655-5677 |
| AD-1615227.1 | CUGGUUCAUUUAAAACUCUUU | 117 | 5742-5762 | AAAGAGTUUUAAAUGAACCAGGC | 2505 | 5740-5762 |
| AD-1615228.1 | GAGCAGGGAUGCAAACGCCAU | 2011 | 5823-5843 | ATGGCGTUUGCAUCCCUGCUCUC | 2506 | 5821-5843 |
| AD-1615229.1 | AGCAGGGAUGCAAACGCCAUU | 2012 | 5824-5844 | AAUGGCGUUUGCAUCCCUGCUCU | 2082 | 5822-5844 |
| AD-1615230.1 | AGGGAUGCAAACGCCAUUUCU | 2013 | 5827-5847 | AGAAAUGGCGUUGCAUCCCUGC | 2507 | 5825-5847 |
| AD-1615231.1 | GGGAUGCAAACGCCAUUUCUU | 2014 | 5828-5848 | AAGAAATGGCGTUUGCAUCCCUG | 2508 | 5826-5848 |
| AD-1615232.1 | GGAUGCAAACGCCAUUUCUUU | 2015 | 5829-5849 | AAAGAAAUGGCGUUUGCAUCCCU | 2085 | 5827-5849 |
| AD-1615233.1 | GAUGCAAACGCCAUUUCUUAU | 2016 | 5830-5850 | ATAAGAAAUGGCGUUUGCAUCCC | 2509 | 5828-5850 |
| AD-1615234.1 | UGCAAACGCCAUUUCUUAUCU | 17 | 5832-5852 | AGAUAAGAAAUGGCGUUUGCAUC | 18 | 5830-5852 |
| AD-1615235.1 | CAAACGCCAUUUCUUAUCAUU | 2017 | 5834-5854 | AAUGAUAAGAAAUGGCGUUUGCA | 2088 | 5832-5854 |
| AD-1615236.1 | AAACGCCAUUUCUUAUCAUGU | 2018 | 5835-5855 | ACAUGAUAAGAAAUGGCGUUUGC | 2510 | 5833-5855 |
| AD-1615237.1 | AACGCCAUUUCUUAUCAUGGU | 2019 | 5836-5856 | ACCATGAUAAGAAAUGGCGUUUG | 2511 | 5834-5856 |
| AD-1615238.1 | ACGCCAUUUCUUAUCAUGGAU | 2020 | 5837-5857 | ATCCAUGAUAAGAAAUGGCGUUUU | 2512 | 5835-5857 |
| AD-1615239.1 | CGCCAUUUCUUAUCAUGGACU | 2021 | 5838-5858 | AGUCCATGAUAAGAAAUGGCGUU | 2513 | 5836-5858 |
| AD-1615240.1 | AUGGGACUAAGCACUGGUAUU | 2022 | 5876-5896 | AAUACCAGUGCUAGUCCCAUUG | 2514 | 5874-5896 |
| AD-1615241.1 | UGGGACUAAGCACUGGUAUCU | 2023 | 5877-5897 | AGAUACCAGUGCUUAGUCCCAUU | 2094 | 5875-5897 |
| AD-1615242.1 | GGGACUAAGCACUGGUAUCAU | 2024 | 5878-5898 | ATGAUACCAGUGCUUAGUCCCAU | 2515 | 5876-5898 |
| AD-1615243.1 | GGACUAAGCACUGGUAUCAUU | 2025 | 5879-5899 | AAUGAUACCAGTGCUUAGUCCCA | 2516 | 5877-5899 |
| AD-1615244.1 | CUAAGCACUGGUAUCAUAUCU | 2026 | 5882-5902 | AGAUAUGAUACCAGUGCUUAGUC | 2097 | 5880-5902 |
| AD-1615245.1 | AAGCACUGGUAUCAUAUCUGU | 2027 | 5884-5904 | ACAGAUAUGAUACCAGUGCUUAG | 2099 | 5882-5904 |
| AD-1615246.1 | AGCACUGGUAUCAUAUCUGAU | 2028 | 5885-5905 | ATCAGATAUGATACCAGUGCUUA | 2517 | 5883-5905 |
| AD-1615247.1 | GCACUGGUAUCAUAUCUGAUU | 2029 | 5886-5906 | AAUCAGAUAUGAUACCAGUGCUU | 2101 | 5884-5906 |
| AD-1615248.1 | CACUGGUAUCAUAUCUGAUUU | 2030 | 5887-5907 | AAAUCAGAUAUGAUACCAGUGCU | 2102 | 5885-5907 |
| AD-1615249.1 | UGGUAUCAUAUCUGAUUCACU | 2031 | 5890-5910 | AGUGAAUCAGATAUGAUACCAGU | 2518 | 5888-5910 |
| AD-1615250.1 | UCAGAGUUUCUGGGUUACUGU | 119 | 5921-5941 | ACAGTAACCCAGAAACUCUGAAG | 2519 | 5919-5941 |
| AD-1615251.1 | AGAAUUGCCUCUAAACCUUU | 120 | 6010-6030 | AAAGGUUAGAGGCAAAUUCUGC | 2520 | 6008-6030 |
| AD-1615252.1 | CUGAAGUCCUGCUAUACCACU | 2032 | 6098-6118 | AGUGGUAUAGCAGGACUUCAGGU | 2104 | 6096-6118 |
| AD-1615253.1 | CUGCUAUACCACAGAGUUCUU | 19 | 6106-6126 | AAGAACTCUGUGGUAUAGCAGGA | 20 | 6104-6126 |
| AD-1615253.2 | CUGCUAUACCACAGAGUUCUU | 19 | 6106-6126 | AAGAACTCUGUGGUAUAGCAGGA | 20 | 6104-6126 |
| AD-1615254.1 | UGCUAUACCACAGAGUUCUAU | 2033 | 6107-6127 | ATAGAACUCGTGGUAUAGCAGG | 2521 | 6105-6127 |
| AD-1615255.1 | GCUAUACCACAGAGUUCUAUU | 2034 | 6108-6128 | AAUAGAACUCUGUGGUAUAGCAG | 2107 | 6106-6128 |
| AD-1615256.1 | CUAUACCACAGAGUUCUAUGU | 2035 | 6109-6129 | ACAUAGAACUCTGUGGUAUAGCA | 2522 | 6107-6129 |
| AD-1615257.1 | AUACCACAGAGUUCUAUGUAU | 2036 | 6111-6131 | ATACAUAGAACUCUGUGGUAUAG | 2523 | 6109-6131 |
| AD-1615258.1 | ACCACAGAGUUCUAUGUAGCU | 2037 | 6113-6133 | AGCUACAUAGAACUCUGUGGUAU | 2112 | 6111-6133 |
| AD-1615259.1 | CCACAGAGUUCUAUGUAGCUU | 903 | 6114-6134 | AAGCTACAUAGAACUCUGUGGUA | 1159 | 6112-6134 |
| AD-1615260.1 | AGAGUUCUAUGUAGCUUACAU | 905 | 6118-6138 | ATGUAAGCUACAUAGAACUCUGU | 2524 | 6116-6138 |
| AD-1615260.2 | AGAGUUCUAUGUAGCUUACAU | 905 | 6118-6138 | ATGUAAGCUACAUAGAACUCUGU | 2524 | 6116-6138 |

TABLE 10-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1615261.1 | GAGUUCUAUGUAGCUUACAGU | 2038 | 6119-6139 | ACUGUAAGCUACAUAGAACUCUG | 2525 | 6117-6139 |
| AD-1615262.1 | UCUAUGUAGCUUACAGUUCCU | 907 | 6123-6143 | AGGAACTGUAAGCUACAUAGAAC | 1163 | 6121-6143 |
| AD-1615262.2 | UCUAUGUAGCUUACAGUUCCU | 907 | 6123-6143 | AGGAACTGUAAGCUACAUAGAAC | 1163 | 6121-6143 |
| AD-1615263.1 | CUAUGUAGCUUACAGUUCCAU | 2039 | 6124-6144 | ATGGAACUGUAAGCUACAUAGAA | 2526 | 6122-6144 |
| AD-1615264.1 | UAUGUAGCUUACAGUUCCAAU | 2040 | 6125-6145 | ATGGAACUGUAAGCUACAUAGA | 2527 | 6123-6145 |
| AD-1615265.1 | UAGCUUACAGUUCCAACCAGU | 2041 | 6129-6149 | ACUGGUTGGAACUGUAAGCUACA | 2528 | 6127-6149 |
| AD-1615266.1 | GAAUGUGAUGUAUUUUAAUGU | 122 | 6184-6204 | ACAUUAAAAUACAUCACAUUCCU | 2529 | 6182-6204 |
| AD-1615267.1 | ACCUAUUGUGGCUAGAUAUAU | 2042 | 6247-6267 | ATAUAUCUAGCCACAAUAGGUGG | 2530 | 6245-6267 |
| AD-1615268.1 | CCUAUUGUGGCUAGAUAUAUU | 2043 | 6248-6268 | AAUAUAUCUAGCCACAAUAGGUG | 2531 | 6246-6268 |
| AD-1615269.1 | UAUUGUGGCUAGAUAUAUUAU | 2044 | 6250-6270 | ATAAUAUAUCUAGCCACAAUAGG | 2532 | 6248-6270 |
| AD-1615270.1 | AUUGUGGCUAGAUAUAUUAGU | 2045 | 6251-6271 | ACUAAUAUAUCUAGCCACAAUAG | 2533 | 6249-6271 |
| AD-1615271.1 | UUGUGGCUAGAUAUAUUAGGU | 2046 | 6252-6272 | ACCUAAUAUAUCUAGCCACAAUA | 2534 | 6250-6272 |
| AD-1615272.1 | UGUGGCUAGAUAUAUUAGGAU | 2047 | 6253-6273 | ATCCTAAUAUAUCUAGCCACAAU | 2535 | 6251-6273 |
| AD-1615273.1 | GUGGCUAGAUAUAUUAGGAUU | 2048 | 6254-6274 | AAUCCUAAUAUAUCUAGCCACAA | 2125 | 6252-6274 |
| AD-1615274.1 | GGCUAGAUAUAUUAGGAUCUU | 915 | 6256-6276 | AAGATCCUAAUAUAUCUAGCCAC | 1171 | 6254-6276 |
| AD-1615275.1 | GCUAGAUAUAUUAGGAUCUCU | 2049 | 6257-6277 | AGAGAUCCUAAUAUAUCUAGCCA | 2536 | 6255-6277 |
| AD-1615276.1 | CCUCUGAAAUGUAUGUAAAGU | 126 | 6579-6599 | ACUUUACAUACAUUUCAGAGGAC | 2537 | 6577-6599 |
| AD-1615277.1 | CUGUGUUAAAUGUUAACAGUU | 48 | 6896-6916 | AACUGUUAACAUUUAACACAGCG | 2538 | 6894-6916 |
| AD-1615278.1 | ACAGUUUUCCACUAUUUCUCU | 21 | 6911-6931 | AGAGAAAUAGUGGAAAACUGUUA | 22 | 6909-6931 |
| AD-1615279.1 | AUGCAAACGCCAUUUCUUAUU | 888 | 5831-5851 | AAUAAGAAAUGGCGUUUGCAUCC | 1144 | 5829-5851 |
| AD-1615280.1 | AUGCAAACGCCAUUUCUUAUA | 2388 | 5831-5851 | UAUAAGAAAUGGCGUUUGCAUCC | 2539 | 5829-5851 |
| AD-1615281.1 | AUGCAAACGCCAUUUCUUAUA | 2388 | 5831-5851 | UAUAAGAAAUGGCGUUUGCAUCC | 2539 | 5829-5851 |
| AD-1615282.1 | AUGCAAACGCCAUUUCUUAUA | 2388 | 5831-5851 | UAUAAGAAATGGCGUUUGCAUCC | 2540 | 5829-5851 |
| AD-1615283.1 | AUGCAAUCGCCAUUUCUUAUA | 2389 | 5831-5851 | UAUAAGAAATGGCGAUUGCAUCC | 2541 | 5829-5851 |
| AD-1615284.1 | AUGCAUACGCCAUUUCUUAUA | 2390 | 5831-5851 | UAUAAGAAATGGCGUAUGCAUCC | 2542 | 5829-5851 |
| AD-1615285.1 | AUGCUAACGCCAUUUCUUAUA | 2391 | 5831-5851 | UAUAAGAAATGGCGUUAGCAUCC | 2543 | 5829-5851 |
| AD-1615286.1 | GCAAACGCCAUUUCUUAUA | 2392 | 5833-5851 | UAUAAGAAATGGCGUUUGCGU | 2544 | 5831-5851 |
| AD-1615287.1 | AUGCAAACGCCAUUUCUUAUU | 888 | 5831-5851 | AAUAAGAAAUGGCGUUUGCAUCC | 1144 | 5829-5851 |
| AD-1615288.1 | AUGCAAACGCCAUUUCUUAUU | 888 | 5831-5851 | AAUAAGAAAUGGCGUUUGCAUCC | 1144 | 5829-5851 |
| AD-1615289.1 | GCAAACGCCAUUUCUUAUU | 2393 | 5833-5851 | AAUAAGAAAUGGCGUUUGCGU | 2545 | 5831-5851 |
| AD-1615290.1 | GCAAACGCCAUUUCUUAUU | 2393 | 5833-5851 | AAUAAGAAAUGGCGUUUGCGU | 2545 | 5831-5851 |
| AD-1615291.1 | AUGCAAUCGCCAUUUCUUAUU | 2394 | 5831-5851 | AAUAAGAAAUGGCGAUUGCAUCC | 2546 | 5829-5851 |
| AD-1615292.1 | AUGCAAUCGCCAUUUCUUAUU | 2394 | 5831-5851 | AAUAAGAAAUGGCGAUUGCAUCC | 2546 | 5829-5851 |
| AD-1615293.1 | AUGCAUACGCCAUUUCUUAUU | 2395 | 5831-5851 | AAUAAGAAAUGGCGUAUGCAUCC | 2547 | 5829-5851 |
| AD-1615294.1 | AUGCAUACGCCAUUUCUUAUU | 2395 | 5831-5851 | AAUAAGAAAUGGCGUAUGCAUCC | 2547 | 5829-5851 |
| AD-1615295.1 | AUGCUAACGCCAUUUCUUAUU | 2396 | 5831-5851 | AAUAAGAAAUGGCGUUAGCAUCC | 2548 | 5829-5851 |
| AD-1615296.1 | AUGCUAACGCCAUUUCUUAUU | 2396 | 5831-5851 | AAUAAGAAAUGGCGUUAGCAUCC | 2548 | 5829-5851 |

TABLE 10-continued

Unmodified Sense and Antisense Strand Sequences of Coagulation Factor V dsRNA Agents

| Duplex

TABLE 10-continued

Unmodified Sense and Antisense Strand Sequences of Coagulation Factor V dsRNA Agents

| Duplex Name | Sense Sequence 5' to 3' | SEQ ID NO: | Range in NM_000130.4 | Antisense Sequence 5' to 3' | SEQ ID NO: | Range in NM_000130.4 |
|---|---|---|---|---|---|---|
| AD-1615334.1 | UCUAUGUAGCUUACAUUUCCU | 2416 | 6123-6143 | AGGAAAUGUAAGCUACAUAGAAC | 2582 | 6121-6143 |
| AD-1615335.1 | UCUAUGUAGCUUACUGUUCCU | 2417 | 6123-6143 | AGGAACAGUAAGCUACAUAGAAC | 2583 | 6121-6143 |
| AD-1615336.1 | CUAUUGUGGCUAGAUUUAUUU | 2418 | 6249-6269 | AAAUAAAUCUAGCCACAAUAGGU | 2584 | 6247-6269 |
| AD-1615337.1 | UCCAUGGUGGACAAGUUUUUU | 2419 | 6659-6679 | AAAAAACUUGUCCACCAUGGAGG | 2585 | 6657-6679 |
| AD-1615338.1 | UCCAUGGUGGACAAUAUUUUU | 2420 | 6659-6679 | AAAAAUAUUGUCCACCAUGGAGG | 2586 | 6657-6679 |
| AD-1615339.1 | AAGAUUUUGAAGGAAAUACU | 936 | 6671-6691 | AGUAUUUCCUUCAAAAAUCUUGU | 1192 | 6669-6691 |
| AD-1615340.1 | AAGAUUUUGAAGGAUAUACU | 2421 | 6671-6691 | AGUAUAUCCUUCAAAAAUCUUGU | 2587 | 6669-6691 |
| AD-1615341.1 | AAGAUUUUGAAGGUAAUACU | 2422 | 6671-6691 | AGUAUUACCUUCAAAAAUCUUGU | 2588 | 6669-6691 |
| AD-1615342.1 | AGAUUUUGAAGGAAUUACUU | 2423 | 6672-6692 | AAGUAAUCCUUCAAAAAUCUUG | 2589 | 6670-6692 |
| AD-1615343.1 | AGAUUUUGAAGGAUAUACUU | 2424 | 6672-6692 | AAGUAUAUCCUUCAAAAAUCUUG | 2590 | 6670-6692 |
| AD-109630.1 | CAGGCUUACAUUGACAUUAAA | 9 | 1106-1126 | UUUAAUGUCAAUGUAAGCCUGCA | 10 | 1104-1126 |

TABLE 11

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-110532.1 | ususaacuUfcCfAfUfgaauucuaguuL96 | 2591 | asCfsuagAfaUfUfcaugGfaAfguuaascsa | 2792 | UGUUAACUUCCAUGAAUUCUAGU | 1830 |
| AD-110931.1 | aggsaacuCfaGfUfUfcucaauucuuuL96 | 2592 | asAfsgaaUfuGfAfgaacUfgAfguucususg | 2793 | CAAGAACUCAGUUCUC TABLE 11-continued Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1454719.1 | ascsccuucCfaAfCfCfAfgaauaucauuL96 | 2609 | asAfsugaUfAfUfcuguUfgAfagggsusug | 2810 | GGUACCUUGAGGACAACAUCAAC | 3016 |
| AD-1454720.1 | cscscuucAfaCfAfGfaauaucauuuL96 | 2610 | asAfsaugAfuAfUfucugUfuGfaaggsusu | 2811 | AAUUCUUCCACAGCAGAGCAUUC | 3017 |
| AD-1454911.1 | asasauccAfaAfGfGfAfauacucuuuuL96 | 2611 | asAfsagaAfgUfAfuucuUfuGfauuusgsa | 2812 | AUUGAUCUGGAAAAUACUGUGUU | 3018 |
| AD-1455310.1 | asasagacUfaCfUfCfaaucauucauuL96 | 2612 | asUfsgaaUfgAfUfugagUfaGfucuuususc | 2813 | CACUCACUGGGCACUCAUUCAU | 3019 |
| AD-1455313.1 | asggacucUfcAfAfAfucauucauuuL96 | 2613 | asAfsaugAfuAfUfGfauugAfgUfagucususu | 2814 | CUUCACUGGGCACUCAUUCAUCU | 3020 |
| AD-1455314.1 | gsascuaUfcAfAfUfcauucauuauaL96 | 2614 | asUfsaauGfaAfUfgauuGfaGfuagucsusu | 2815 | AUGACUAUGCUGAAAUUGAUUAU | 3021 |
| AD-1455522.1 | asasacucUfcCfCfAfcauuucccuuL96 | 2615 | asAfsggaAfaUfGfuuggAfgAfguguuscsc | 2816 | GAUGCCAUCUCCCUCAUCUCCUA | 3022 |
| AD-1455659.1 | gsasugaaGfucAfAfAfcucuacuuuL96 | 2616 | asAfsaagUfagAfGfguugAfcUfucaucsusu | 2817 | AAGAUGAAGUCAACUCUUCUUUC | 3023 |
| AD-1455664.1 | asgsucaacCfuCfUfUfcuuucaccuuL96 | 2617 | asAfsgguGfaAfAfagagAfgUfugacususc | 2818 | GAAGUCAACUCUUCUUUCACCUC | 3024 |
| AD-1455701.1 | gsascauuAfgGfCfAfAfaacaucuuuuL96 | 2618 | asAfsaagAfuGfUfuugaCfaAfaugucsasu | 2819 | AAAAAAACAGCCAAGCAUCUUUC | 3025 |
| AD-1455771.1 | cscsuuccUfcAfGfAfcuuaaauucuuL96 | 2619 | asAfsgauUfcAfAfgucuGfaGfgaaggsgsa | 2820 | UCCUAGAGUUAGACAUAAAUCUC | 625 |
| AD-1455780.1 | uscsagacUfuAfAfAfucucuuuacuuL96 | 2620 | asGfsuaaAfAfGfauuuAfGfucugasgsg | 2821 | AGUUAGACAUAAAUCUCACAAG | 3026 |
| AD-1455807.1 | gsasauugGfaUfCfAfaacaauuauuL96 | 2621 | asAfsuaaUfuGfUfuugaUfcCfaauucsug | 2822 | GUCUUUCCAUAUAACAAUGAUU | 3027 |
| AD-1457108.1 | asusuaggUfcGfCfUfUfcagaaacucuL96 | 2622 | asGfsaguUfcUfCfUfgaauGfaCfcuaaususc | 2823 | GAAUCAGGUCAUUCCGAAACUCA | 3028 |
| AD-1457130.1 | gsasagaaGfaGfUfUfgAfcaaucuuacuL96 | 2623 | asGfsuaaGfaUfUfguacUfcUfucuucsusu | 2824 | AAGAGAAGAGUUCAUCUUACU | 567 |
| AD-1457237.1 | ususcgaCfaCfAfGfauauaauugulL96 | 2624 | asCfsaauUfaUfAfucugUfgUfcgaasgsa | 2825 | UCUUCAAACACAGAUAUAAUUGU | 3029 |
| AD-1458307.1 | asasgcaaAfuUfAfCfugcaucuuculL96 | 2625 | asGfsaagAfuUfGfaguaAfuUfugcusgsu | 2826 | ACAAGCAAAUCACAGCUUCUUCG | 3030 |
| AD-1458619.1 | uscsauugUfuGfCfUfucauaaaucuuL96 | 2626 | asGfsauuUfaUfGfaagcAfaCfaaugasasu | 2827 | AUUCGUUGGUGCUUCAUAAAUCC | 3031 |
| AD-1458724.1 | usasaucaGfaAfUfUfcucgaaguuL96 | 2627 | asCfsauuCfgAfGfgaauUfGfgauuaasug | 2828 | CAUAAUCAGAAUUCUCAAAUGA | 3032 |
| AD-1459277.1 | uscsugaaUfcAfGfUfcaguuaauuuL96 | 2628 | asAfsauaAfcUfGfacuaGfaUfucagasasg | 2829 | CUUCUGAAUCUAGUCAGUCAUUG | 3033 |
| AD-1459922.1 | gsasacugAfaUfAfUfucaaaaccuL96 | 2629 | asGfsguuUfuUfGfaauaUfuCfaguucsusa | 2830 | UAGAAUUGAACAUUCAAAACCCC | 3033 |
| AD-1465918.3 | asusgccucaCfAfCfacucuauuuL96 | 1224 | asdAsaudAgdAugugdTgUfgaggcausgsg | 1484 | CCAUGCCUCACACACUCUAUUA | 1748 |
| AD-1465918.4 | asusgccucaCfAfCfacucuauuuL96 | 1224 | asdAsaudAgdAugugdTgUfgaggcausgsg | 1484 | CCAUGCCUCACACACUCUAUUA | 1748 |

TABLE 11-continued

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1465919.2 | usgsccucacAfCfAfcaucuauauL96 | 1225 | asdTsaadTadGaugudGuGfugaggcasusg | 1485 | CAUGCCUCACACACAUCUAUUAC | 1749 |
| AD-1465920.2 | gscscucacaCfAfCfaucuauuacuuL96 | 1226 | asdGsuadAudAgaugdTgUfgaggcsasu | 1486 | AUGCCUCACACACAUCUAUUACU | 1750 |
| AD-1465921.2 | cscsucacaCfAfCfAfucuauuacuuL96 | 1227 | asdAsgudAadTagaudGuGfuguaggscsa | 1487 | UGCCUCACACACAUCUAUUACUC | 1751 |
| AD-1465922.3 | csuscacacaCfAfUfcuauuacucuL96 | 1228 | asdGsagdTadAuagadTgUfgugugagsgsc | 1488 | GCCUCACACACAUCUAUUACUCC | 1752 |
| AD-1465922.4 | csuscacacaCfAfUfcuauuacucuL96 | 1228 | asdGsagdTadAuagadTgUfgugugagsgsc | 1488 | GCCUCACACACAUCUAUUACUCC | 1752 |
| AD-1465927.2 | gsascguuugAfCfAfagcaaaucguL96 | 1233 | asdCsgadTudTgcuudGuCfaaacgcsusu | 1493 | AAGACGUUUGACAAGCAAAUCGU | 1757 |
| AD-1465932.3 | asasuguacaCfAfGfucaauggauuL96 | 1238 | asdAsucdCadTugacdTgUfguacauuusasg | 1498 | CUAAUGUACACAGUCCAAUGGAUA | 1762 |
| AD-1465932.4 | asasuguacaCfAfGfucaauggauuL96 | 1238 | asdAsucdCadTugacdTgUfguacauuusasg | 1498 | CUAAUGUACACAGUCCAAUGGAUA | 1762 |
| AD-1465953.3 | gscsaggcUfuAfCfAfuugacauuauuL96 | 1259 | asUfsaadTg(Tgn)caauguAfaGfccugcsasu | 1519 | AUGCAGGCUUACAUUGACAUUAA | 1783 |
| AD-1465954.3 | csasggcuUfaCfAfUfugacauuaauL96 | 335 | asUfsuadAu(G2p)ucaauguUfaAfgccugcsa | 1520 | UGCAGGCUUACAUUGACAUUAAA | 603 |
| AD-1465960.3 | usascauugaCfAfUfuaaaaacuguL96 | 1265 | asdCsagdTudTuuaadTgUfcaauguasasg | 1526 | CUUACAUUGACAUUAAAAACUGC | 1789 |
| AD-1465968.3 | csasccuguaAfUfAfccagcgaauuL96 | 1273 | asdAsuudCgdCuggudAuUfacaggugscsa | 1534 | UGCACCUGUAAUACCAGCGAAUA | 1797 |
| AD-1465968.4 | csasccuguaAfUfAfccagcgaauuL96 | 1273 | asdAsuudCgdCuggudAuUfacaggugscsa | 1534 | UGCACCUGUAAUACCAGCGAAUA | 1797 |
| AD-1465969.2 | usgsuaauccAfGfCfgaauauggauL96 | 1274 | asdCscadTadTucgcdTgGfuauuacasgsg | 1535 | CCUGUAAUACCAGCGAAUAUGGA | 1798 |
| AD-1465970.2 | gsusaauaccAfGfCfgaauauggauL96 | 1275 | asdTsccdAudAuucgdCuGfguauuacsasg | 1536 | CUGUAAUACCAGCGAAUAUGGAC | 1799 |
| AD-1466053.3 | uscsggaaUfuCfUfUfggcccuauuL96 | 377 | asAfsaudAg(G2p)accaagAfaUfuccgasgsa | 1618 | UCUCGGAAUUCUUGGUCCUAUUA | 645 |
| AD-1466070.2 | gsasgagaauUfUfGfuccuuacuauuL96 | 1373 | asdAsuaGfudAagacdAaAftuucucuuusu | 1635 | AUGAGAAUUUGUCCUUACUAUU | 576 |
| AD-1466083.3 | asasagagaGfCfUfgguacuauguuL96 | 1386 | asdCsaudAgdTaccadGcUfcuucuuuusus | 1648 | GAAAAGAAGAGCUGGUACUAUGA | 1909 |
| AD-1466100.4 | asusgcaaacGfCfCfcauuucuuauuL96 | 1403 | asdAsuudAgdAaaugdGcGfuuuugcauscsc | 1665 | GGAUGCAAACGCCAUUUCUUAUC | 1926 |
| AD-1466100.5 | asusgcaaacGfCfCfcauuucuuauuL96 | 1403 | asdAsuudAgdAaaugdGcGfuuuugcauscsc | 1665 | GGAUGCAAACGCCAUUUCUUAUC | 1926 |
| AD-1466101.2 | gscsaaacgcCfAfUfuucuuaucauL96 | 1404 | asdTsgadTadAgaaadTgGfcguuugcsasu | 1666 | AUGCAAACGCCAUUUCUUAUCAU | 1927 |
| AD-1466104.3 | usasagcacuGfGfUfaucauaucuuL96 | 1407 | asdAsgadTadTgauadCcAfgugcuuasgsu | 1669 | ACUAAGCACUGGUAUCAUAUCUG | 1930 |
| AD-1466104.4 | usasagcacuGfGfUfaucauaucuuL96 | 1407 | asdAsgadTadTgauadCcAfgugcuuasgsu | 1669 | ACUAAGCACUGGUAUCAUAUCUG | 1930 |
| AD-1466114.4 | csusgcuaUfaCfCfAfcagagaucuuL96 | 1416 | asAfsgadAc(Tgn)cuguggUfaUfagcagsgsa | 1679 | UCCUGCUAUACCACAGAGUCUA | 1939 |

TABLE 11-continued

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1466115.2 | usasuaccacAfGfAfguucuauguuL96 | 1417 | asdAscadTadGaacudCuGfuggauaasgsc | 1680 | GCUAUACCACAGAGUUCUAUGUA | 1940 |
| AD-1466116.2 | usasccacagAfGfUfucuauguaguL96 | 1418 | asdCsuadCadTagaadCuCfuguguasusa | 1681 | UAUACCACAGAGUUCUAUGUAGC | 1941 |
| AD-1466118.3 | csascagaguUfCfUfauguaguaguaguL96 | 1420 | asdAsagdCudAcauadGaAfucugugsgsu | 1683 | ACCACAGAGUUCUAUGUAGCUUA | 1943 |
| AD-1466119.3 | aggsaguuCfuAfUfGfuagcuacauL96 | 1421 | asUfsgudAa(G2p)cuacauAfgAfacucusgsu | 1684 | ACAGAGUUCUAUGUAGCUUACAG | 1944 |
| AD-1466120.2 | aggsuucuauGfUfAfgcuuacaguL96 | 1422 | asdAscudGudAagcudAcAfuagaacuscsu | 1685 | AGAGUUCUAUGUAGCUUACAGUU | 1945 |
| AD-1466121.3 | uscsuauguGfaGfCfUfuacagauccuL96 | 1423 | asGfsgadAc(Tgn)guaagcUfaCfauagasasc | 1686 | GUUCUAUGUAGCUUACAGUCCA | 1946 |
| AD-1466128.3 | csusauuguGfCfUfagauauauuuL96 | 1430 | asdAsaudAudAucuadGcCfacaauagsgsu | 1693 | ACCUAUGUGGCUAGAUAUAUUA | 1953 |
| AD-1466128.4 | csusauuguGfCfUfagauauauuuL96 | 1430 | asdAsaudAudAucuadGcCfacaauagsgsu | 1693 | ACCUAUGUGGCUAGAUAUAUUA | 1953 |
| AD-1466139.3 | usccauuguGfGfAfcaagauuuuuL96 | 1440 | asdAsaadAudCuugudCcAfcaugasgsg | 1704 | CCUCCAUGGUGGACAAGAUUUUU | 1963 |
| AD-1466151.3 | asasgauuUfuUfGfAfaggaaauacuuL96 | 1452 | asGfsuadTu(Tgn)ccuucaAfaAfaucusgsu | 1716 | ACAAGAUUUUUGAAGGAAAUACU | 1975 |
| AD-1466152.3 | aggsauuuuuGfAfAfggaaauaucuL96 | 1453 | asdAsgudAudTuccudTcAfaaaaucusug | 1717 | CAAGAUUUUGAAGGAAAUACUA | 1976 |
| AD-1615169.1 | cscsacaaacUfCfAfaguuugaauuL96 | 2630 | asdAsuudCadAacuudGaGfuguuggsgsc | 2831 | GCCCACACAUCUCAAGUUGAAUC | 591 |
| AD-1615170.1 | asusucuucuGfUfAfacuuccuuuuL96 | 2631 | asdAsaadGgdAaguudAcAfgaagaususc | 2832 | GAAUCUUCUGUAACUCCCUUUA | 592 |
| AD-1615171.1 | aggsuaugaaCfCfAfuauuuuuaaguL96 | 2632 | asdCsuudAadAauauadGgUfucauacuscsu | 2833 | AGAGUAUGACCAUUAUUUAAGA | 593 |
| AD-1615172.1 | csusaccauuUfCfAfggacucucuuuL96 | 2633 | asdAsagdAadGuccudGaAfauggagsasu | 2834 | AUCUACCAUUUCAGGACUCUUG | 594 |
| AD-1615173.1 | ceasugccucAfCfAfcacacuauuL96 | 2634 | asdAsuadGadTgugudGuGfaggcaugsgsa | 2835 | UCCAUGCCUCACACACAUCUAUU | 2290 |
| AD-1615174.1 | uccsacacaAfUfCfuauuacuccuL96 | 2635 | asdGsgadGudAauagdAuGfuguguagsgg | 2836 | CCUCACACAUCUAUUACUCCC | 598 |
| AD-1615175.1 | ceasucuauuAfCfUfcccaugaaauL96 | 2636 | asdTsuudCadTggadGuAfauagaugsusg | 2837 | CACAUCUAUUACUCCCAUGAAAA | 2291 |
| AD-1615176.1 | uccsugaucgAfGfGfauuucaacuuL96 | 2637 | asdAsgudTgdAaaucdCuCfgaucagasusu | 2838 | AAUCUGAUCGAGGAUUUCAACUC | 599 |
| AD-1615177.1 | gggsgacacaGfAfAfgacguuugauL96 | 2638 | asdTscadAadCgucudTcUfugucccsasc | 2839 | GUGGGACACAGAAGACGUUUGAC | 2292 |
| AD-1615178.1 | gggsacacagAfAfGfacguuugacuL96 | 2639 | asdGsucdAadAcgucdTuCfugugucccsa | 2840 | UGGGACACAGAAGACGUUUGACA | 2293 |
| AD-1615179.1 | gsascacagaAfGfAfcguuugacauL96 | 2640 | asdTsgudCadAacgudCuUfcugugucscsc | 2841 | GGGACACAGAAGACGUUUGACAA | 2294 |
| AD-1615180.1 | gsasagacguUfUfGfacaagcaauL96 | 2641 | asdTsuudGcdTugucdAaAfcaagcaauL96 | 2842 | CAGAAGACGUUUGACAAGCAAAU | 1755 |

TABLE 11-continued

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1615181.1 | ascsguuugaCfAfAfgcaaaucguuL96 | 2642 | asdAscgdAudTugcudTgUfcaaacgscsu | 2843 | AGACGUUUGACAAGCAAAUCUG | 2295 |
| AD-1615182.1 | cgsuuugacAfAfGfcaaaucgugcuL96 | 2643 | asdCsacdGadTuugcdTuUfcaaacgsusc | 2844 | GACGUUUGACAAGCAAAUCUGC | 2296 |
| AD-1615183.1 | gsusuugacaAfGfCfaaaucgugcuL96 | 2644 | asdGscadCgdAuuugdCuUfgucaaacsgsu | 2845 | ACGUUUGACAAGCAAAUCGUGCU | 2297 |
| AD-1615184.1 | ususugacaAfCfAfaaucgugcuuL96 | 2645 | asdAsgcdAcdGauuudGcUfugucaaascsg | 2846 | CGUUUGACAAGCAAAUCGUGCUA | 2298 |
| AD-1615185.1 | cscsuaauguAfCfAfcagucaaugul96 | 2646 | asdCsaudTgdAcugudGuAfcauuaggsgsa | 2847 | UCCCUAAUGUACACAGUCAAUGG | 2299 |
| AD-1615186.1 | csusaauguaCfAfCfagucaaugguL96 | 2647 | asdCscadTudGacugdTgUfcauuagsgsg | 2848 | CCCUAAUGUACACAGUCAAUGGA | 2300 |
| AD-1615187.1 | usasauguacAfCfAfgucaauggaul96 | 2648 | asdTsccdAudTgacudGuGfuacauuasgsg | 2849 | CCUAAUGUACACAGUCAAUGGAU | 2301 |
| AD-1615188.1 | asusuauucuCfCfAfuaucuucucuL96 | 2649 | asdTsgadAadTgaaudGgAfgaauaaususc | 2850 | GAAUAUUCUCCAUUCAUUUCAA | 602 |
| AD-1615189.1 | asasagnggaUfCfAfuaucuucucuL96 | 2650 | asdGsagdAadGauaudGaUfccauuuscsc | 2851 | GGAAAGUGGAUCAUAUCUUCUCU | 561 |
| AD-1615190.1 | cscsaggaauUfUfUfaagaaaauauL96 | 2651 | asdTsaudTudTcuuadAgAfuuccuggsusu | 2852 | AACCAGGAAUCUUAAGAAAAUAA | 604 |
| AD-1615191.1 | gsgsacuaugCfAfCfcuguaauaccL96 | 2652 | asdGsuadTudcAcaggdTgCfauaguccssa | 2853 | UGGGACUAUGCACCUGUAAUACC | 2302 |
| AD-1615192.1 | gsascuaugcAfCfCfuguaauacsL96 | 2653 | asdGsgudAudTacagdGuGfcauagucscsc | 2854 | GGGACUAUGCACCUGUAAUACCA | 2303 |
| AD-1615193.1 | ascsuaugcaCfCfUfguaauaccaul96 | 2654 | asdTsggdTadTuacadGgUfgcauaguscsc | 2855 | GGACUAUGCACCUGUAAUACCAG | 2304 |
| AD-1615194.1 | csusaugcacCfUfGfuaauaccagul96 | 2655 | asdCsugdGdGudAuuacdAgGfugcauagsusc | 2856 | GACUAUGCACCUGUAAUACCAGC | 2305 |
| AD-1615195.1 | gscsaccuguAfAfUfaccagcgaaul96 | 2656 | asdTsucdGcdTgguadTuAfcaggugcsasu | 2857 | AUGCACCUGUAAUACCAGCGAAU | 2306 |
| AD-1615196.1 | ascscuguaaUfAfCfcagcgaauaul96 | 2657 | asdTsaudTcdGcuggdTaUfuacaggusgsc | 2858 | GCACCUGUAAUACCAGCGAAUAU | 2307 |
| AD-1615197.1 | cscsuguaauAfCfCfagcgaauauL96 | 2658 | asdAsuadTudCgcugdGuAfuuacagsgsug | 2859 | CACCUGUAAUACCAGCGAAUAUG | 2308 |
| AD-1615198.1 | csusguaauaCfCfAfgcgaauaugul96 | 2659 | asdCsaudAudTcgcudGgUfauuacagsgsu | 2860 | ACCUGUAAUACCAGCGAAUAUGG | 2309 |
| AD-1615199.1 | usasauaccaGfCfGfaauaugggacul96 | 2660 | asdGsucdCadTauucdGcUfguauuascsa | 2861 | UGUAAUACCAGCGAAUAUGGACA | 2310 |
| AD-1615200.1 | uscsagcauuUfGfGfauauuucuuL96 | 2661 | asdAsgadAadTuaucdCaAfugcuugasgsa | 2862 | UCUCAGCAUUUGGAUAAUUCUC | 2862 |
| AD-1615201.1 | ascsacucaaAfAfUfcguguagaguuL96 | 2662 | asdTsugdAadCacgadTuUfugagugusgsu | 2863 | ACACACUCAAAAUCGUGUAGAGUU | 2864 |
| AD-1615202.1 | usasagnggaAfCfAfucuuagaguul96 | 2663 | asdAscudCudAagaudGuUfccacuuasusa | 2864 | UAUAAGUGGACAUCUUAGAGUU | 563 |
| AD-1615203.1 | usasacagaCfCfAfuacuacaguL96 | 2664 | asdAscudGudAguaudGgUfcuuguuasasg | 2865 | CUUAACAAGACCAUUCUACAGUG | 610 |
| AD-1615204.1 | csasuucaucUfAfUfggaaagaggcL96 | 2665 | asdCscudCudTuccadTaGfaugaaugsasg | 2866 | CUCAUUCAUCUAUGGAAAGAGGC | 613 |

TABLE 11-continued

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1615205.1 | ususggaacuUfGfGfaugugauacuuL96 | 2666 | asdAsgudTadAcaucdCaAfguuccaascsa | 2867 | UGUUGGAACUUGGAUGUUAACUU | 566 |
| AD-1615206.1 | usasacuuccAfUfGfaaucuaguuuL96 | 2667 | asdAscudAgdAauucdAuGfaaguuasasasc | 2868 | GUUAACUUCCAUGAAUUCUAGUC | 614 |
| AD-1615207.1 | csccsgaaacuCfAfUfcauugaaucuuL96 | 2668 | asdGsaudTcdAaugadTgAfguuccgsasas | 2869 | UUCCGAAACUCAUCAUUGAAUCA | 616 |
| AD-1615208.1 | ucssaaacaCfAfGfAfuauaauuguuL96 | 2669 | asdAscadAudTauaudTauaudAuAfuauauguasasg | 2870 | CUUCAAACACAGAUAUAAUUGUU | 568 |
| AD-1615209.1 | gsusugguucAfAfAfuauucucucuuL96 | 2670 | asdGsaadGadAuaaudTuGfaaccaacsasa | 2871 | UUGUUGGUUCAAAUAUUCUUCC | 618 |
| AD-1615210.1 | acssucaguuCfUfCfaauucuccuuL96 | 2671 | asdGsgadGadAguuugdAgAfcugagususuc | 2872 | GAACUCAGUUCUCAAUUCUUCCA | 620 |
| AD-1615211.1 | usascgucuaCfUfUfcacuugguuL96 | 2672 | asdAsccdAadGuaadAgUfagacguasusc | 2873 | GAUACCGUCUACUUUCACUGGUG | 621 |
| AD-1615212.1 | asasguaacuCfAfUfcauaaaucuuL96 | 2673 | asdAsaadTcdTuaagadTgAfguuacuususg | 2874 | CAAAGAACUCAUCUAAGAUUU | 569 |
| AD-1615213.1 | csusagaguuAfUfGfAfcauaaaucuuL96 | 2674 | asdAsgadTudTaugudCuAfacucuagsgsa | 2875 | UCCUAGAGUUAGACACGAAAUC | 625 |
| AD-1615214.1 | ususucucauUfAfAfAfgacacgaaaauL96 | 2675 | asdTsudCgdTgucudTaAfugagaaascsu | 2876 | AGUUCUCAUUAAGACACGAAAA | 627 |
| AD-1615215.1 | usgsaagccuAfCfAfacacauuuuuL96 | 2676 | asdAsaadAudGuguudGuAfggcuucascsu | 2877 | AGUGAGGCCUACAACACAUUUU | 628 |
| AD-1615216.1 | asasuccaauGfAfAfacucuucuuL96 | 2677 | asdAsagdAgdAguudTcAfuuggauususa | 2878 | UAAAUCCAAUGAAAACAUCUUC | 629 |
| AD-1615217.1 | uscsaaaugcAfCfUfcuacucagauL96 | 2678 | asdCsugdAadGuagadGuGfcauugasusc | 2879 | GAUCAAAUGCACUCUACUUCAGA | 632 |
| AD-1615218.1 | uasucucucaAfUfGfauacuuuucuuL96 | 2679 | asdGsaadAadGuaucdAuUfgagaguasgsg | 2880 | CCUACUCUCAUGAUACUUUUCU | 573 |
| AD-1615219.1 | csusaucaaaGfGfAfauuuaauccuuL96 | 2680 | asdGsgadTudAaauudCcUfugauuagsasa | 2881 | UUCUAUCAAAGGAAUUUAAUCCA | 641 |
| AD-1615220.1 | ascsuagcugGfAfAfauugauuauuL96 | 2681 | asdAsuadAudCaauudTcAfgcauaguscsa | 2882 | UGACUAUGCUGAAAUGAUUAUG | 643 |
| AD-1615221.1 | asasacagaaGfAfAfauuauuacauL96 | 2682 | asdTsgudAadTaauudTcUfucuguuuscsc | 2883 | GGAAACAGAAGAAAUUAUUACAU | 574 |
| AD-1615222.1 | asgscacuuuUfAfCfcaaacgugauL96 | 2683 | asdTscadCgdTuuggdTaAfaagugcusgsu | 2884 | ACAGACUUUACCAAACGUGAU | 575 |
| AD-1615223.1 | ususauccaaGfUfUfcguuuuaaauL96 | 2684 | asdTsuudAadAacgadAcUfuggauaascsa | 2885 | UGUUAUCCAAGUUCGUUUUAAAA | 646 |
| AD-1615224.1 | asusgcguuCfAfGfccaaaauagcuL96 | 2685 | asdGscudAudTuggcdTgAfacagcaususa | 2886 | UAAUGCUGUUCAGCCAAAUAGCA | 647 |
| AD-1615225.1 | usasgcaguuAfUfAfccuacguauuL96 | 2686 | asdAsuadCgdTaggudAuAfacugcuasusu | 2887 | AAUAGCAGUUAUACCUACGUAUG | 648 |
| AD-1615226.1 | aggscauucaCfGfUfggucacuuuL96 | 2687 | asdAsagdTgdAaccadCgUfgaaugucsusu | 2888 | AAGACAUUCACGUGUUCACUUU | 577 |
| AD-1615227.1 | csusggucauUfUfUfaaaacucuuuL96 | 2688 | asdAsagdAgdTuuuadAaUfgaaccagsgsc | 2889 | GCCUGGUUCAUUUAAAACUCUUG | 649 |

TABLE 11-continued

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1615228.1 | gsasgcagggAfUfGfcaaacgccauL96 | 2689 | asdTsggdCgdTuugcdAuCfccugcucsusc | 2890 | GAGAGCAGGGAUGCAAACGCCAU | 2311 |
| AD-1615229.1 | agsgcagggaUfGfCfaaacgccauuL96 | 2690 | asdAsugdGcdGuuugdCaUfcccugcucsu | 2891 | AGAGCAGGGAUGCAAACGCCAUU | 2312 |
| AD-1615230.1 | agsggaugcAfAfAfcgccauuucuL96 | 2691 | asdGsaadAudGgcugdTuGfcauccucsgsc | 2892 | GCAGGGAUGCAAACGCCAUUUCU | 2313 |
| AD-1615231.1 | gsgsgaugcaAfAfCfgccauuucuuL96 | 2692 | asdAsgadAadTggcgdTuUfgcauccesusg | 2893 | CAGGGAUGCAAACGCCAUUUCUU | 2314 |
| AD-1615232.1 | gsgsaugcaaAfCfGfccauuucuuuL96 | 2693 | asdAsagdAadAuggcGdUfugcauccscsu | 2894 | AGGGAUGCAAACGCCAUUUCUUA | 2315 |
| AD-1615233.1 | gsasugcaaaCfGfCfcauuucuuauL96 | 2694 | asdTsaadGadAauggdCgUfuugcaucscsc | 2895 | GGGAUGCAAACGCCAUUUCUUAU | 2316 |
| AD-1615234.1 | uSgscaaacgCfCfAfuuucuuaaucuL96 | 2695 | asdGsaudAadGaaaudGgCfguuugcasusc | 2896 | GAUGCAAACGCCAUUUCUUAUCA | 650 |
| AD-1615235.1 | csasaacgccAfUfUfucuuaucaucuL96 | 2696 | asdAsugdAudAagaadAuUfgcguuugscsa | 2897 | UGCAAACGCCAUUUCUUAUCAUG | 2317 |
| AD-1615236.1 | asasacgccaUfUfUfcuuaucauguL96 | 2697 | asdCsaudGadTaagadAaUfggcguuusgsc | 2898 | GCAAACGCCAUUUCUUAUCAUGG | 2318 |
| AD-1615237.1 | asasacgccauUfUfCfcuuaucauggguL96 | 2698 | asdCscadTgdAuaagdAaAfuggcguususg | 2899 | CAAACGCCAUUUCUUAUCAUGGA | 2319 |
| AD-1615238.1 | ascsgccauuUfCfUfuaucauggauL96 | 2699 | asdTsccdAudGauaadGaAfauggcgusustu | 2900 | AAACGCCAUUUCUUAUCAUGGAC | 2320 |
| AD-1615239.1 | csgsccauuucUfUfUfaucauggacuL96 | 2700 | asdGsucdCadTgauadAgAfaauggcgsusu | 2901 | AACGCCAUUUCUUAUCAUGGACA | 2321 |
| AD-1615240.1 | asusgggacuAfAfGfcacugguaucuL96 | 2701 | asdAsuadCcdAgucdTuAfgucccausug | 2902 | CAAUGGACUAAGCACUGGUAUC | 2322 |
| AD-1615241.1 | usgsggacuaAfGfCfacugguaucuL96 | 2702 | asdGsaudAcdCagugdCtUfagucccasusu | 2903 | AAUGGACUAAGCACUGGUAUCA | 2323 |
| AD-1615242.1 | gsgsgacuaaGfCfAfcugguaucauL96 | 2703 | asdTsgadTadCcagudGcUfuagucccasa | 2904 | AUGGGACUAAGCACUGGUAUCAU | 2324 |
| AD-1615243.1 | gsgsgacuaagCfAfCfugguaucauuL96 | 2704 | asdAsugdAudAccagdTgCfuuaguccscsa | 2905 | UGGGACUAAGCACUGGUAUCAUA | 2325 |
| AD-1615244.1 | csusaagcacUfGfGfuaucauaucuL96 | 2705 | asdGsaudAudGauacdCaGfugcuuagsusc | 2906 | GACUAAGCACUGGUAUCAUAUCU | 2326 |
| AD-1615245.1 | asasgcacugGfUfAfucauaucuguL96 | 2706 | asdCsagdAudAugaudAcCfagugcuusasg | 2907 | CUAAGCACUGGUAUCAUAUCUGA | 2327 |
| AD-1615246.1 | asgscacuggUfAfUfcauaucugauL96 | 2707 | asdTscadGadTaugadTaCfcagugcususa | 2908 | UAAGCACUGGUAUCAUAUCUGAU | 2328 |
| AD-1615247.1 | gscsacugguAfUfCfauaucugauuL96 | 2708 | asdAsucdAgdAuaugdAuAfccagugcsusu | 2909 | AAGCACUGGUAUCAUAUCUGAUU | 2329 |
| AD-1615248.1 | csascugguaUfCfAfuaucugauuL96 | 2709 | asdAsaudCadGauaudGaUfaccagugscsu | 2910 | AGCACUGGUAUCAUAUCUGAUUC | 2330 |
| AD-1615249.1 | usgsguaucaUfAfUfcugauucacuL96 | 2710 | asdGsugdAadTcagadTaUfgauaccasgsu | 2911 | ACUGGUAUCAUAUCUGAUUCACA | 2331 |
| AD-1615250.1 | uscsagaguuUfCfUfgguuacacuuL96 | 2711 | asdCsagdTadAcccadGaAfacucugasasg | 2912 | CUUCAGAGUUUCUGGUUACACUGG | 652 |
| AD-1615251.1 | asggaauugCfCfUfcuaaccuuuL96 | 2712 | asdAsagdGudTuagadGgCfaaauucusgsc | 2913 | GCAGAAUUGCCUCUAAACCUUG | 653 |

TABLE 11-continued

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1615252.1 | csusgaagucCfUfGfcuauaccacuL96 | 2713 | asdGsugdGdAuagcdAgGfacuucagsgsu | 2914 | ACCUGAAGUCCUGCUAUACCACA | 2332 |
| AD-1615253.1 | csusgcuauaCfCfAfcagaguucuuuL96 | 2714 | asdAsgadAcdTcugudGgUfauagcagsgsa | 2915 | UCCUGCUAUACCACAGAGUUCUUA | 1939 |
| AD-1615253.2 | csusgcuauaCfCfAfcagaguucuuL96 | 2714 | asdAsgadAcdTcugudGgUfauagcagsgsa | 2915 | UCCUGCUAUACCACAGAGUUCUUA | 1939 |
| AD-1615254.1 | uggcuauaccCfAfCfagaguucuauL96 | 2715 | asdTsagdAadCucugdTgGfuauagcasgsg | 2916 | CCUGCUAUACCACAGAGUUCUAU | 2333 |
| AD-1615255.1 | gscsuauaccAfCfAfgaguucuauuL96 | 2716 | asdAsuadGadAcucudGuGfguauagcsasg | 2917 | CUGCUAUACCACAGAGUUCUAUG | 2334 |
| AD-1615256.1 | csusauaccaCfAfGfaguucuauguL96 | 2717 | asdCsaudAgdAacucdTguUfguauagcscsa | 2918 | UGCUAUACCACAGAGUUCUAUGU | 2335 |
| AD-1615257.1 | asusaccacaGfAfGfuucuauguauL96 | 2718 | asdTsacdAudAgaacdTcUfgugguausasg | 2919 | CUAUACCACAGAGUUCUAUGUAG | 2336 |
| AD-1615258.1 | ascscacagaGfUfUfcuauguagcuL96 | 2719 | asdGscudAcdAuagadAcUfcugugusasu | 2920 | AUACCACAGAGUUCUAUGUAGCU | 2337 |
| AD-1615259.1 | cscsacagagUfUfCfuauguagcuuL96 | 2720 | asdAsgcdTadCauagdAaCfucugugsusa | 2921 | UACCACAGAGUUCUAUGUAGCUU | 1942 |
| AD-1615260.1 | agsgaguucaAfUfGfuagcuuacaguL96 | 2721 | asdTsgudAadGcuacdAuAfgaacucusgsu | 2922 | ACAGAGUUCUAUGUAGCUUACAG | 1944 |
| AD-1615260.2 | agsgaguucaAfUfGfuagcuuacaguL96 | 2721 | asdTsgudAadGcuacdAuAfgaacucusgsu | 2922 | ACAGAGUUCUAUGUAGCUUACAG | 1944 |
| AD-1615261.1 | gsasguucuaUfGfUfuagcuuacaguL96 | 2722 | asdCsugdTadAgcuadCaUfagaacucsusg | 2923 | CAGAGUUCUAUGUAGCUUACAGU | 2338 |
| AD-1615262.1 | uscsuauguaGfCfUfuacaguccuL96 | 2723 | asdGsgadAcdTguaadGcUfacauagasasc | 2924 | GUUCUAUGUA TABLE 11-continued Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1615272.1 | usguggcuaGfAfUfauauaggauL96 | 2733 | asdTsccdTadAuauadTcUfagccacasasu | 2934 | AUUGUGGCUAGAUAUAUUAGGAU | 2347 |
| AD-1615273.1 | gsusggcuagAfUfAfauauaggauuL96 | 2734 | asdAsucdCudAuauadAuUfuagccacsasa | 2935 | UUGUGGCUAGAUAUAUUAGGAUC | 2348 |
| AD-1615274.1 | gsgscuagauAfUfAfuuaggaucuuL96 | 2735 | asdAsgadTcdCuaaudAuAfucuagccsasc | 2936 | GUGGCUAGAUAUAUUAGGAUCUC | 1954 |
| AD-1615275.1 | gscsuagauaUfAfUfuaggaucucuL96 | 2736 | asdGsagdAudCcuaadTaUfaucuagcscsa | 2937 | UGGCUAGAUAUAUUAGGAUCUCU | 2349 |
| AD-1615276.1 | cscsucugaaAfUfGfuauguaagusL96 | 2737 | asdCsuudTadCauacdAuUfucagaggsasc | 2938 | GUCCUCUGAAAUGUAGUAAAGA | 659 |
| AD-1615277.1 | csusuguguaAfAfUfguuaacaguuL96 | 2738 | asdAscudGudUaacadTuUfaacacagscsg | 2939 | CGCUGUGUAAAUGUUAACAGUU | 578 |
| AD-1615278.1 | acscaguuuuCfCfAfcuauucucuL96 | 2739 | asdGsagdAadAuaguGfgAfaaacugususa | 2940 | UAACAGUUUCCACUAUUUCUCU | 579 |
| AD-1615279.1 | asusgcaaAfcGfCfCfauuucuauuL96 | 2165 | asAfsuaaGfaaauggcGfuUfugcauscsc | 2941 | GGAUGCAAACGCCAUUUCUUAUC | 1926 |
| AD-1615280.1 | asusgcaaacGfCfCfauuucuauaL96 | 2740 | usdAsuadAgdAaaugdGcGfuuugcauscsc | 2942 | GGAUGCAAACGCCAUUUCUUAUC | 1926 |
| AD-1615281.1 | asusgcaaacGfCfCfauuucuauaL96 | 2740 | usdAsuadAgdAgdAaaadTggcGfauugcauscsc | 2943 | GGAUGCAAACGCCAUUUCUUAUC | 1926 |
| AD-1615282.1 | asusgcaaucGfCfCfauuucuauaL96 | 2741 | usdAsuadAgdAgdAaaadTggcGfauugcauscsc | 2944 | GGAUGCAAACGCCAUUUCUUAUC | 1926 |
| AD-1615283.1 | asusgcaaucGfCfCfauuucuauaL96 | 2742 | usdAsuadAgdAgdAaaadTggcGfuauugcauscsc | 2945 | GGAUGCAAACGCCAUUUCUUAUC | 1926 |
| AD-1615284.1 | asusgcuaacGfCfCfauuucuauaL96 | 2743 | usdAsuadAgdAgdAaaadTggcGfuuagcauscsc | 2946 | GGAUGCAAACGCCAUUUCUUAUC | 1926 |
| AD-1615285.1 | gscssaaacGfCfCfauuucuauaL96 | 2744 | usdAsuadAgdAgdAaaadTggcGfuuugcsgsu | 2947 | GGAUGCAAACGCCAUUUCUUAUC | 1926 |
| AD-1615286.1 | asusgcaaacGfCfCfAfuuucuauuL96 | 2745 | asdAsuadAgdAgdAaaugdGcGfuuugcauscsc | 2948 | AUGCAAACGCCAUUUCUUAUC | 3034 |
| AD-1615287.1 | asusgcaaacgCfCfdAfuuucuauuL96 | 2746 | asdAsuadAgdAgdAaaugdGcGfuuugcauscsc | 1665 | GGAUGCAAACGCCAUUUCUUAUC | 1926 |
| AD-1615288.1 | gscssaaacgCfCfdAfuuucuauuL96 | 2747 | asdAsuadAgdAgdAaaugdGcGfuuugcsgsu | 1665 | GGAUGCAAACGCCAUUUCUUAUC | 1926 |
| AD-1615289.1 | gscssaaacgCfCfdAfuuucuauuL96 | 2748 | asdAsuadAgdAgdAaaugdGcGfuuugcsgsu | 2949 | AUGCAAACGCCAUUUCUUAUC | 3034 |
| AD-1615290.1 | asusgcaaucgCfCfdAfuuucuauuL96 | 2749 | asdAsuadAgdAgdAaaugdGcGfauugcauscsc | 2949 | AUGCAAACGCCAUUUCUUAUC | 3034 |
| AD-1615291.1 | asusgcaaucgCfCfdAfuuucuauuL96 | 2750 | asdAsuadAgdAgdAaaugdGcGfauugcauscsc | 2950 | GGAUGCAAACGCCAUUUCUUAUC | 1926 |
| AD-1615292.1 | asusgcauucgCfCfdAfuuucuauuL96 | 2751 | asdAsuadAgdAgdAaaugdGcGfuauugcauscsc | 2950 | GGAUGCAAACGCCAUUUCUUAUC | 1926 |
| AD-1615293.1 | asusgcauucgCfCfdAfuuucuauuL96 | 2752 | asdAsuadAgdAgdAaaugdGcGfuauugcauscsc | 2951 | GGAUGCAAACGCCAUUUCUUAUC | 1926 |
| AD-1615294.1 | asusgcauacgCfCfdAfuuucuauuL96 | 2753 | asdAsuadAgdAgdAaaugdGcGfuuagcauscsc | 2951 | GGAUGCAAACGCCAUUUCUUAUC | 1926 |
| AD-1615295.1 | asusgcuaacgCfCfdAfuuucuauuL96 | | asdAsuadAgdAgdAaaugdGcGfuuagcauscsc | 2952 | GGAUGCAAACGCCAUUUCUUAUC | 1926 |

TABLE 11-continued

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1615296.1 | asusgcuaacgCfCfdAfuuucuuauuL96 | 2754 | asdAsuadAgdAaaugdGcGfuuagcauscsc | 2952 | GGAUGCAAACGCCAUUUCUUAUC | 1926 |
| AD-1615297.1 | asusgcaaacgCfCfAfuuucuuauaL96 | 2755 | usdAsuadAgdAaaugdGcGfuuugcauscsc | 2942 | GGAUGCAAACGCCAUUUCUUAUC | 1926 |
| AD-1615298.1 | gscsaaacgCfCfAfuuucuuauaL96 | 2756 | usdAsuadAgdAaaugdGcGfuuugcsgsu | 2953 | AUGCAAACGCCAUUUCUUAUC | 3034 |
| AD-1615299.1 | asusgcauacgCfCfAfuuucuuauaL96 | 2757 | usdAsuadAgdAaaugdGcGfuaugcauscsc | 2954 | GGAUGCAAACGCCAUUUCUUAUC | 1926 |
| AD-1615300.1 | asusgcccucaCfAfCfacauuuauuL96 | 2758 | asdAsaudAadAugugdTgUfgaggcausgsg | 2955 | CCAUGCCUCACACACAUCUAUUA | 1748 |
| AD-1615301.1 | csuscacacaCfAfUfcuauuauucuL96 | 2759 | asdGsaadTadAuagadTgUfgugugagsgsc | 2956 | GCCUCACACACAUCUAUUACUCC | 1752 |
| AD-1615302.1 | csuscacacaCfAfUfcuauuucucuL96 | 2760 | asdGsagdAadAuagadTgUfgugugagsgsc | 2957 | GCCUCACACACAUCUAUUACUCC | 1752 |
| AD-1615303.1 | asasuguacaCfAfGfucauugauuL96 | 2761 | asdAsucdCadAugacdTgUfguacauuasag | 2958 | CUAAUGUACACAGUCAAUGGAUA | 1762 |
| AD-1615304.1 | gscsaggcuuaAfCfAfuugacauauuL96 | 2762 | asdTsaadTgdTcaaudGuAfagccugscsasu | 2959 | AUGCAGGCUUACAUUGACACAUUAA | 1783 |
| AD-1615305.1 | gscsaggcuuaAfCfAfuugauauuauL96 | 2763 | asdTsaadTadTcaaudGuAfagccugcsasu | 2960 | AUGCAGGCUUACAUUGACACAUUAA | 1783 |
| AD-1615306.1 | gscsaggcuuaAfCfAfuugucauuauL96 | 2764 | asdTsaadTgdAcaaudGuAfagccugcsasu | 2961 | AUGCAGGCUUACAUUGACACAUUAA | 1783 |
| AD-1615307.1 | csasggcuuaCfAfUfugacauuauL96 | 2765 | aaUfsuadAudGucaaugUfaAfgccugscsa | 2962 | UGCAGGCUUACAUUGACACAUUAAA | 603 |
| AD-1615308.1 | csasggcuuaCfAfUfugacauuaauL96 | 2766 | asUfsuadAadGucaaugUfaAfgccugscsa | 2963 | UGCAGGCUUACAUUGACACAUUAAA | 603 |
| AD-1615309.1 | csasggcuuaCfAfUfugacauuauauL96 | 2767 | asUfsuadAudGucaaugUfaAfgccugscsa | 2964 | UGCAGGCUUACAUUGACACAUUAAA | 603 |
| AD-1615310.1 | csasggcuuaCfAfUfugacauuaauL96 | 2765 | asUfsuadAudGucaaugUfaAfgccugscsg | 2965 | UGCAGGCUUACAUUGACACAUUAAA | 603 |
| AD-1615311.1 | csasggcuuaCfAfUfugacauuaauL96 | 2766 | asUfsuadAadGucaaugUfaAfgccugscsg | 2966 | UGCAGGCUUACAUUGACACAUUAAA | 603 |
| AD-1615312.1 | csasggcuuaCfAfUfugauauuaauL96 | 2767 | asUfsuadAudGucaaugUfaAfgccugscsg | 2967 | UGCAGGCUUACAUUGACACAUUAAA | 603 |
| AD-1615313.1 | uasascauugaCfAfUfuaaaauacuguL96 | 2768 | asdCsagdTadTuuaadTgUfcaauguasasg | 2968 | CUUACAUUGACAUUAAAAAACUGC | 1789 |
| AD-1615314.1 | uasascauugaCfAfUfuaaaaaacuguL96 | 2769 | asdCsagdTudAuuaadTgUfcaauguasasg | 2969 | CUUACAUUGACAUUAAAAAACUGC | 1789 |
| AD-1615315.1 | csasccuguaAfUfAfccaucgaauuL96 | 2770 | asdAsuudCgdAuggudAuUfacaggugscsa | 2970 | UGCACCUGUAAUACCAGCGAAUA | 1797 |
| AD-1615316.1 | csasccuguaAfUfAfccaucgaauuL96 | 2771 | asdAsuudCadCuggudAuUfacaggugscsa | 2971 | UGCACCUGUAAUACCAGCGAAUA | 1797 |
| AD-1615317.1 | csasccuguaAfUfAfccaucgaauuL96 | 2770 | asdAsuudCadCuggudAuUfacaggugscsg | 2972 | UGCACCUGUAAUACCAGCGAAUA | 1797 |
| AD-1615318.1 | csasccuguaAfUfAfccaucgaauuL96 | 2771 | asdAsuudCgdAuggudAuUfacaggugscsg | 2973 | UGCACCUGUAAUACCAGCGAAUA | 1797 |

TABLE 11-continued

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1615319.1 | uscsggaauuCfUfUfgguccuauuuL96 | 2772 | asdAsaudAgdGaccadAgAfauuccgasgsa | 2974 | UCUCGAAUUCUUGGUCCUAUUA | 645 |
| AD-1615320.1 | uscsggaauuCfUfUfgguccuauuuL96 | 2773 | asdAsaudAadGaccadAgAfauuccgasgsa | 2975 | UCUCGAAUUCUUGGUCCUAUUA | 645 |
| AD-1615321.1 | uscsggaauuCfUfUfgguccuauuuL96 | 2774 | asdAsaudAgdAaccadAgAfauuccgasgsa | 2976 | UCUCGAAUUCUUGGUCCUAUUA | 645 |
| AD-1615322.1 | uscsggaauuCfUfUfgguccuauuuL96 | 2772 | asdAsaudAgdGaccadAgAfauuccgasgsg | 2977 | UCUCGAAUUCUUGGUCCUAUUA | 645 |
| AD-1615323.1 | uscsggaauuCfUfUfgguccuauuuL96 | 2773 | asdAsaudAadGaccadAgAfauuccgasgsg | 2978 | UCUCGAAUUCUUGGUCCUAUUA | 645 |
| AD-1615324.1 | uscsggaauuCfUfUfgguccuauuuL96 | 2774 | asdAsaudAgdAaccadAgAfauuccgasgsg | 2979 | UCUCGAAUUCUUGGUCCUAUUA | 645 |
| AD-1615325.1 | asasagagaGfCfUfgguauuauguL96 | 2775 | asdCsaudAadTaccadGcUfcuucuuususc | 2980 | GAAAAGAGAGCUGGUACUAUGA | 1909 |
| AD-1615326.1 | asasagagaGfCfUfgguauuauguL96 | 2776 | asdCsaudAgdAaccadGcUfcuucuuususc | 2981 | GAAAAGAGAGCUGGUACUAUGA | 1909 |
| AD-1615327.1 | usasagcacuGfCfAfaucuuaucuL96 | 2777 | asdAsgadTadAgauadCcAfgugcuuasgsu | 2982 | ACUAAGCACUGGUAUCAUAUCUG | 1930 |
| AD-1615328.1 | csusgcuauaCfCfAfcagauuucuuL96 | 2778 | asdAsgadAadTcugudGgUfauagcagsgsa | 2983 | UCCUGCUAUACCACAGAGUCUA | 1939 |
| AD-1615329.1 | csusgcuauaCfCfAfcagauuucuuL96 | 2779 | asdAsgadAcdAcugudGgUfauagcagsgsa | 2984 | UCCUGCUAUACCACAGAGUCUA | 1939 |
| AD-1615330.1 | csusgcuauaCfCfAfcagauuucuuL96 | 2714 | asdAsgadAcdTcugudGgUfauagcagsgsg | 2985 | UCCUGCUAUACCACAGAGUCUA | 1939 |
| AD-1615331.1 | csusgcuauaCfCfAfcagauuucuuL96 | 2778 | asdAsgadAadTcugudGgUfauagcagsgsg | 2986 | UCCUGCUAUACCACAGAGUCUA | 1939 |
| AD-1615332.1 | csusgcuauaCfCfAfcagauuucuuL96 | 2779 | asdAsgadAcdAcugudGgUfauagcagsgsg | 2987 | UCCUGCUAUACCACAGAGUCUA | 1939 |
| AD-1615333.1 | aggsaguucuAfUfGfuaguuuacauL96 | 2780 | asdTsgudAadAcuacdAuAfgaacucusgsu | 2988 | ACAGAGUUCUAUGUAGCUUACAG | 1944 |
| AD-1615334.1 | uscsuauguaGfCfUfuacauuuccuL96 | 2781 | asdGsgadAadTguaadGcUfacauagasasc | 2989 | GUUCUAUGUAGCUUACAGUCCA | 1946 |
| AD-1615335.1 | uscsuauguaGfCfUfuacuguuccuL96 | 2782 | asdGsgadAcdAguaadGcUfacauagasasc | 2990 | GUUCUAUGUAGCUUACAGUCCA | 1946 |
| AD-1615336.1 | csusauugugGfCfUfagauuuauuL96 | 2783 | asdAsaudAadAucuadGcCfacauuagsgsu | 2991 | ACCUAUUGUGGCUAGAUAUAUUA | 1953 |

TABLE 11-continued

Modified Sense and Antisense Strand Sequences of Coagulation Factor V dsRNA Agents

| Duplex Name | Sense Strand Sequence 5' to 3' | SEQ ID NO: | Antisense Strand Sequence 5' to 3' | SEQ ID NO: | mRNA target sequence 5' to 3' | SEQ ID NO: |
|---|---|---|---|---|---|---|
| AD-1615337.1 | uscscaugguGfGfAfcaaguuuuuL96 | 2784 | asdAsaadAadCuugudCcAfccauggasgsg | 2992 | CCUCCAUGGUGGACAAGAUUUUU | 1963 |
| AD-1615338.1 | uscscaugguGfGfAfcaauauuuuuL96 | 2785 | asdAsaadAudAuugudCcAfccauggasgsg | 2993 | CCUCCAUGGUGGACAAGAUUUUU | 1963 |
| AD-1615339.1 | asasgauuuuUfGfAfaggaaauacuL96 | 2786 | asdGsuadTudTccuudCaAfaaaucuusgsu | 2994 | ACAAGAUUUUGAAGGAAAUACU | 1975 |
| AD-1615340.1 | asasgauuuuUfGfAfaggauauacuL96 | 2787 | asdGsuadTadTccuudCaAfaaaucuusgsu | 2995 | ACAAGAUUUUGAAGGAAAUACU | 1975 |
| AD-1615341.1 | asasgauuuuUfGfAfagguauacuL96 | 2788 | asdGsuadTudAccuudCaAfaaaucuusgsu | 2996 | ACAAGAUUUUGAAGGAAAUACU | 1975 |
| AD-1615342.1 | agsgauuuuuGfAfAfggaauuacuuL96 | 2789 | asdAsgudAadTuccudTcAfaaaaucusug | 2997 | CAAGAUUUUGAAGGAAAUACUA | 1976 |
| AD-1615343.1 | asgsgauuuuuGfAfAfggauauacuuL96 | 2790 | asdAsgudAudAuccudTcAfaaaaucusug | 2998 | CAAGAUUUUGAAGGAAAUACUA | 1976 |
| AD-109630.1 | csasggcuUfacCfAfUfugacauuaaaL96 | 2791 | usUfsuaaUfgUfCfaaugUfaAfgccugscsa | 2999 | UGCAGGCUUACAUUGACAUUAAA | 603 |

TABLE 12

Coagulation Factor V Single Dose Screens in Primary Human Hepatocytes

| | 10 nM | | 1 nM | | 0.1 nM | |
|---|---|---|---|---|---|---|
| Duplex | Avg % message remaining | SD | Avg % message remaining | SD | Avg % message remaining | SD |
| AD-1615169.1 | 19.61 | 2.96 | 23.03 | 1.68 | 34.68 | 4.64 |
| AD-1615170.1 | 9.34 | 2.01 | 16.84 | 0.89 | 20.30 | 1.29 |
| AD-1615171.1 | 10.83 | 1.58 | 20.81 | 2.15 | 25.81 | 4.01 |
| AD-1615172.1 | 19.13 | 1.04 | 27.51 | 6.36 | 34.74 | 7.69 |
| AD-1452209.1 | 95.97 | 18.27 | 107.65 | 4.60 | 72.03 | 4.84 |
| AD-1452212.1 | 102.65 | 12.31 | 104.27 | 2.41 | 102.70 | 1.05 |
| AD-1615173.1 | 25.76 | 4.89 | 23.92 | 3.50 | 25.41 | 7.03 |
| AD-1465918.3 | 11.40 | 1.00 | 12.43 | 1.23 | 17.39 | 0.70 |
| AD-1615300.1 | 35.31 | 4.74 | 32.85 | 1.48 | 40.40 | 6.59 |
| AD-1465918.4 | 11.47 | 1.60 | 18.33 | 2.57 | 23.58 | 3.65 |
| AD-1465919.2 | 31.07 | 2.99 | 30.06 | 7.09 | 33.37 | 6.50 |
| AD-1465920.2 | 18.18 | 0.81 | 16.54 | 1.80 | 20.14 | 0.68 |
| AD-1410823.1 | 32.27 | 4.27 | 44.57 | 3.38 | 42.43 | 2.31 |
| AD-1465921.2 | 25.01 | 1.78 | 26.16 | 5.77 | 39.81 | 3.94 |
| AD-1465922.3 | 12.35 | 1.70 | 23.84 | 3.46 | 26.15 | 2.18 |
| AD-1615301.1 | 31.80 | 6.20 | 43.09 | 5.28 | 45.95 | 1.40 |
| AD-1615302.1 | 28.25 | 2.78 | 40.70 | 3.44 | 48.78 | 6.29 |
| AD-1465922.4 | 18.53 | 1.33 | 22.95 | 2.26 | 37.45 | 4.81 |
| AD-1615174.1 | 35.90 | 3.82 | 41.27 | 6.31 | 57.23 | 6.15 |
| AD-1615175.1 | 18.84 | 1.18 | 23.13 | 2.37 | 39.38 | 8.04 |
| AD-1454350.1 | 40.47 | 2.43 | 52.78 | 5.44 | 71.69 | 6.74 |
| AD-1615176.1 | 16.62 | 2.73 | 21.61 | 1.76 | 29.78 | 3.47 |
| AD-1615177.1 | 21.51 | 2.44 | 28.43 | 3.46 | 39.50 | 5.36 |
| AD-1615178.1 | 29.26 | 3.15 | 33.32 | 3.18 | 40.85 | 5.41 |
| AD-1615179.1 | 23.85 | 6.63 | 27.73 | 5.10 | 30.14 | 2.64 |
| AD-1615180.1 | 19.52 | 0.96 | 21.40 | 2.21 | 34.49 | 4.13 |
| AD-1465927.2 | 29.57 | 0.79 | 36.70 | 2.73 | 53.33 | 10.25 |
| AD-1615181.1 | 14.28 | 2.51 | 23.41 | 5.42 | 31.25 | 5.06 |
| AD-1615182.1 | 14.72 | 0.68 | 27.60 | 2.31 | 38.56 | 3.66 |
| AD-1615183.1 | 24.04 | 1.86 | 32.04 | 2.11 | 45.51 | 5.73 |
| AD-1615184.1 | 9.51 | 1.63 | 17.98 | 1.39 | 21.02 | 2.22 |
| AD-1615185.1 | 18.32 | 2.44 | 19.25 | 3.60 | 24.27 | 2.16 |
| AD-1615186.1 | 18.77 | 1.50 | 26.91 | 4.05 | 34.73 | 4.35 |
| AD-1615187.1 | 43.24 | 3.92 | 49.91 | 5.01 | 72.11 | 5.44 |
| AD-1465932.3 | 17.29 | 1.90 | 19.49 | 1.27 | 22.93 | 2.01 |
| AD-1615303.1 | 14.01 | 0.83 | 18.08 | 1.50 | 22.39 | 3.12 |
| AD-1465932.4 | 14.61 | 1.38 | 23.28 | 3.33 | 30.97 | 6.50 |
| AD-1615188.1 | 19.49 | 1.00 | 26.99 | 4.65 | 35.11 | 3.79 |
| AD-1452985.1 | 121.76 | 5.55 | 111.64 | 4.81 | 112.61 | 7.14 |
| AD-1615189.1 | 20.03 | 4.37 | 24.21 | 3.71 | 35.18 | 3.89 |
| AD-1465953.3 | 9.67 | 1.88 | 11.62 | 0.58 | 16.18 | 0.87 |
| AD-1615304.1 | 9.84 | 1.25 | 15.30 | 0.79 | 21.26 | 4.06 |
| AD-1615305.1 | 32.05 | 8.21 | 34.17 | 4.18 | 40.12 | 6.21 |
| AD-1615306.1 | 21.09 | 1.41 | 28.29 | 2.60 | 37.13 | 3.99 |
| AD-1465954.3 | 12.58 | 1.34 | 14.66 | 2.28 | 18.98 | 1.62 |
| AD-1615307.1 | 9.14 | 1.17 | 14.61 | 1.18 | 14.89 | 2.94 |
| AD-1615308.1 | 26.79 | 2.43 | 32.19 | 3.25 | 31.56 | 4.38 |
| AD-1615309.1 | 11.89 | 1.28 | 11.04 | 2.69 | 21.23 | 4.05 |
| AD-1615310.1 | 6.86 | 0.92 | 8.38 | 0.88 | 14.17 | 3.54 |
| AD-1615311.1 | 21.31 | 3.23 | 21.51 | 7.39 | 15.11 | 0.39 |
| AD-1615312.1 | 12.75 | 1.73 | 18.36 | 3.38 | 18.37 | 1.58 |
| AD-1465960.3 | 12.66 | 0.67 | 20.33 | 2.93 | 18.79 | 2.53 |
| AD-1615313.1 | 34.74 | 4.85 | 31.70 | 4.10 | 43.14 | 9.13 |
| AD-1615314.1 | 37.48 | 3.77 | 36.17 | 2.37 | 33.18 | 1.24 |
| AD-1615190.1 | 18.74 | 2.43 | 25.34 | 2.90 | 30.29 | 4.24 |
| AD-1454911.1 | 89.52 | 13.17 | 94.99 | 6.35 | 78.03 | 15.42 |
| AD-1615191.1 | 20.21 | 2.24 | 24.56 | 1.16 | 31.37 | 2.16 |
| AD-1615192.1 | 62.12 | 4.56 | 63.67 | 2.56 | 79.15 | 3.00 |
| AD-1615193.1 | 24.12 | 1.20 | 35.49 | 0.72 | 48.64 | 3.49 |
| AD-1615194.1 | 28.86 | 1.81 | 33.94 | 3.15 | 53.82 | 5.99 |
| AD-1615195.1 | 22.36 | 1.86 | 27.86 | 1.99 | 47.97 | 3.44 |
| AD-1465968.3 | 17.57 | 1.97 | 20.90 | 2.88 | 18.46 | 4.89 |
| AD-1615315.1 | 26.59 | 5.01 | 20.24 | 3.77 | 36.07 | 7.85 |
| AD-1615316.1 | 16.57 | 1.72 | 21.08 | 2.99 | 25.85 | 3.72 |
| AD-1615317.1 | 23.28 | 1.44 | 26.94 | 0.41 | 29.62 | 3.39 |
| AD-1615318.1 | 21.74 | 2.50 | 22.11 | 5.30 | 28.82 | 4.28 |
| AD-1465968.4 | 17.28 | 3.68 | 20.93 | 2.00 | 31.07 | 2.94 |
| AD-1615196.1 | 14.63 | 1.81 | 27.73 | 4.13 | 40.39 | 7.39 |
| AD-1615197.1 | 20.10 | 1.86 | 27.35 | 2.85 | 39.64 | 4.25 |
| AD-1615198.1 | 18.65 | 2.05 | 27.03 | 2.73 | 31.24 | 3.18 |
| AD-1465969.2 | 26.71 | 5.31 | 34.58 | 5.05 | 42.00 | 1.43 |
| AD-1465970.2 | 63.54 | 4.90 | 79.87 | 8.62 | 95.91 | 5.22 |
| AD-1615199.1 | 20.20 | 1.85 | 21.28 | 4.19 | 38.03 | 4.19 |

TABLE 12-continued

Coagulation Factor V Single Dose Screens in Primary Human Hepatocytes

| | 10 nM | | 1 nM | | 0.1 nM | |
|---|---|---|---|---|---|---|
| Duplex | Avg % message remaining | SD | Avg % message remaining | SD | Avg % message remaining | SD |
| AD-1615200.1 | 21.63 | 1.66 | 25.63 | 0.83 | 31.41 | 5.51 |
| AD-1411340.1 | 33.93 | 4.55 | 47.50 | 4.30 | 70.04 | 1.50 |
| AD-1411342.2 | 27.86 | 3.91 | 38.68 | 4.42 | 46.88 | 5.15 |
| AD-1615201.1 | 22.04 | 0.93 | 31.14 | 2.35 | 38.35 | 1.16 |
| AD-1454529.1 | 101.06 | 10.58 | 86.25 | 9.89 | 87.87 | 11.41 |
| AD-1455659.1 | 34.38 | 3.40 | 48.89 | 8.56 | 51.81 | 3.33 |
| AD-1455664.1 | 75.46 | 5.40 | 80.73 | 8.57 | 85.24 | 3.65 |
| AD-1453516.1 | 108.90 | 7.04 | 102.05 | 5.00 | 92.88 | 0.84 |
| AD-1615202.1 | 18.14 | 4.02 | 29.27 | 3.47 | 38.76 | 2.74 |
| AD-1615203.1 | 21.56 | 2.55 | 32.43 | 2.01 | 40.78 | 3.16 |
| AD-1453784.1 | 50.97 | 6.45 | 52.69 | 4.50 | 76.16 | 11.01 |
| AD-1615204.1 | 63.12 | 5.13 | 68.49 | 2.99 | 82.50 | 14.91 |
| AD-1615205.1 | 23.72 | 1.49 | 24.50 | 0.78 | 34.33 | 1.10 |
| AD-1411797.1 | 25.11 | 2.40 | 35.16 | 1.50 | 47.02 | 2.95 |
| AD-110532.1 | 57.13 | 8.33 | 62.15 | 6.83 | 76.90 | 4.57 |
| AD-1411798.2 | 93.84 | 6.26 | 60.36 | 5.70 | 105.26 | 9.03 |
| AD-1615206.1 | 35.48 | 3.11 | 46.00 | 3.58 | 61.24 | 6.57 |
| AD-1454175.1 | 85.99 | 8.93 | 90.46 | 7.74 | 86.83 | 14.08 |
| AD-1454221.1 | 107.00 | 1.57 | 107.00 | 19.78 | 102.63 | 7.81 |
| AD-1457108.1 | 84.50 | 4.44 | 53.47 | 11.80 | 92.79 | 15.28 |
| AD-1615207.1 | 16.50 | 2.52 | 24.86 | 3.32 | 30.68 | 2.91 |
| AD-1457130.1 | 34.29 | 2.37 | 38.98 | 5.36 | 50.42 | 10.79 |
| AD-1457237.1 | 27.22 | 0.60 | 33.02 | 5.20 | 48.06 | 2.55 |
| AD-1615208.1 | 20.23 | 2.36 | 26.97 | 3.11 | 33.74 | 4.78 |
| AD-1615209.1 | 20.43 | 2.57 | 35.23 | 6.36 | 40.22 | 7.48 |
| AD-1454534.1 | 117.47 | 12.05 | 88.25 | 13.04 | 110.32 | 7.50 |
| AD-110931.1 | 20.67 | 1.79 | 31.19 | 6.20 | 40.87 | 2.64 |
| AD-1615210.1 | 18.93 | 1.50 | 27.31 | 1.57 | 38.84 | 4.69 |
| AD-1454719.1 | 98.59 | 8.57 | 100.98 | 11.53 | 88.88 | 15.84 |
| AD-1454720.1 | 87.00 | 8.17 | 105.09 | 10.43 | 76.40 | 15.13 |
| AD-1615211.1 | 20.67 | 1.49 | 30.27 | 3.38 | 34.74 | 0.96 |
| AD-1615212.1 | 12.54 | 1.93 | 19.34 | 3.29 | 24.88 | 3.41 |
| AD-1455771.1 | 105.78 | 16.60 | 97.10 | 16.16 | 106.08 | 8.33 |
| AD-1615213.1 | 14.85 | 1.73 | 19.39 | 1.73 | 25.76 | 1.21 |
| AD-1412539.2 | 29.21 | 1.58 | 31.71 | 0.73 | 46.33 | 5.89 |
| AD-1615214.1 | 15.90 | 0.51 | 23.27 | 2.24 | 34.08 | 2.99 |
| AD-1615215.1 | 16.98 | 2.18 | 23.59 | 1.05 | 21.30 | 3.85 |
| AD-1455310.1 | 105.66 | 14.84 | 90.80 | 20.50 | 114.48 | 5.58 |
| AD-1455313.1 | 81.97 | 14.75 | 104.10 | 6.69 | 87.53 | 11.75 |
| AD-1455314.1 | 87.04 | 10.11 | 93.84 | 11.90 | 84.33 | 15.90 |
| AD-1458619.1 | 59.20 | 4.16 | 43.56 | 5.66 | 70.10 | 9.37 |
| AD-1455701.1 | 102.60 | 8.09 | 107.23 | 9.47 | 98.74 | 3.38 |
| AD-1615216.1 | 14.83 | 1.20 | 26.19 | 4.58 | 26.72 | 2.07 |
| AD-1458724.1 | 79.38 | 8.96 | 70.03 | 6.58 | 99.83 | 7.51 |
| AD-1455522.1 | 95.35 | 14.81 | 104.05 | 5.93 | 84.76 | 21.56 |
| AD-1615217.1 | 30.87 | 1.78 | 42.71 | 0.38 | 52.10 | 8.67 |
| AD-1455780.1 | 114.40 | 14.12 | 100.40 | 13.53 | 93.66 | 14.64 |
| AD-1455807.1 | 103.09 | 18.99 | 96.11 | 10.03 | 112.14 | 12.72 |
| AD-1459277.1 | 46.30 | 3.52 | 51.01 | 4.82 | 72.76 | 4.56 |
| AD-112393.1 | 28.34 | 2.57 | 36.01 | 4.50 | 51.38 | 5.48 |
| AD-1413196.1 | 33.79 | 4.63 | 40.18 | 2.16 | 51.59 | 2.52 |
| AD-1615218.1 | 19.11 | 4.18 | 29.19 | 4.37 | 32.39 | 3.79 |
| AD-1615219.1 | 21.28 | 5.77 | 28.26 | 5.74 | 32.48 | 4.86 |
| AD-1615220.1 | 10.09 | 1.72 | 17.40 | 1.67 | 24.16 | 5.20 |
| AD-1615221.1 | 22.09 | 1.76 | 31.25 | 1.60 | 43.54 | 3.14 |
| AD-1615222.1 | 24.85 | 2.10 | 35.35 | 1.98 | 46.03 | 2.06 |
| AD-1466053.3 | 18.23 | 1.54 | 16.77 | 2.26 | 20.05 | 2.32 |
| AD-1615319.1 | 18.40 | 2.52 | 18.90 | 1.41 | 23.27 | 3.34 |
| AD-1615320.1 | 39.24 | 4.80 | 35.53 | 1.89 | 37.37 | 6.49 |
| AD-1615321.1 | 14.43 | 1.76 | 24.52 | 2.97 | 31.11 | 2.65 |
| AD-1615322.1 | 10.93 | 1.91 | 20.89 | 2.66 | 33.86 | 2.82 |
| AD-1615323.1 | 21.68 | 2.25 | 35.49 | 4.34 | 41.49 | 10.95 |
| AD-1615324.1 | 11.35 | 0.62 | 27.46 | 1.27 | 36.65 | 4.81 |
| AD-1615223.1 | 15.97 | 2.89 | 25.23 | 3.11 | 38.40 | 5.05 |
| AD-1615224.1 | 26.91 | 5.68 | 39.50 | 8.84 | 47.13 | 9.82 |
| AD-1615225.1 | 20.07 | 0.96 | 28.27 | 5.54 | 35.35 | 7.55 |
| AD-1466070.2 | 16.18 | 2.02 | 25.04 | 3.47 | 26.13 | 2.62 |
| AD-1466083.3 | 13.64 | 1.36 | 30.43 | 3.95 | 28.88 | 5.15 |
| AD-1615325.1 | 20.68 | 4.66 | 36.33 | 3.73 | 36.98 | 12.07 |
| AD-1615326.1 | 17.18 | 3.24 | 28.39 | 1.38 | 29.62 | 7.92 |
| AD-1615226.1 | 12.46 | 0.86 | 16.32 | 1.63 | 21.66 | 5.56 |
| AD-1615227.1 | 17.87 | 1.96 | 22.78 | 1.99 | 28.14 | 2.11 |
| AD-1615228.1 | 65.18 | 14.56 | 63.16 | 3.33 | 72.51 | 5.75 |

TABLE 12-continued

Coagulation Factor V Single Dose Screens in Primary Human Hepatocytes

| | 10 nM | | 1 nM | | 0.1 nM | |
|---|---|---|---|---|---|---|
| Duplex | Avg % message remaining | SD | Avg % message remaining | SD | Avg % message remaining | SD |
| AD-1615229.1 | 18.69 | 0.62 | 28.57 | 2.83 | 33.63 | 4.53 |
| AD-1615230.1 | 38.21 | 8.53 | 38.82 | 2.31 | 47.79 | 4.34 |
| AD-1615231.1 | 24.37 | 4.50 | 29.32 | 3.56 | 45.81 | 6.31 |
| AD-1615232.1 | 22.61 | 1.51 | 26.56 | 2.11 | 30.23 | 4.05 |
| AD-1615233.1 | 13.78 | 2.36 | 22.63 | 3.10 | 25.18 | 4.01 |
| AD-1466100.4 | 17.06 | 4.19 | 21.22 | 0.66 | 30.77 | 3.56 |
| AD-1615279.1 | 27.11 | 2.20 | 39.02 | 4.45 | 50.98 | 4.41 |
| AD-1615280.1 | 19.69 | 3.66 | 24.00 | 3.36 | 29.98 | 4.96 |
| AD-1615281.1 | 25.34 | 2.90 | 29.89 | 3.40 | 33.46 | 2.85 |
| AD-1615282.1 | 22.19 | 3.32 | 30.27 | 1.17 | 37.25 | 4.78 |
| AD-1615283.1 | 60.04 | 3.49 | 63.42 | 6.66 | 62.27 | 4.65 |
| AD-1615284.1 | 35.84 | 3.14 | 34.25 | 5.22 | 46.96 | 3.78 |
| AD-1615285.1 | 29.87 | 3.89 | 28.62 | 3.76 | 33.54 | 3.74 |
| AD-1615287.1 | 30.09 | 4.86 | 34.67 | 1.75 | 41.50 | 1.72 |
| AD-1615288.1 | 48.14 | 6.75 | 51.41 | 3.16 | 49.89 | 4.89 |
| AD-1615291.1 | 80.92 | 7.15 | 74.34 | 9.29 | 73.12 | 2.43 |
| AD-1615292.1 | 78.74 | 2.87 | 71.96 | 4.46 | 71.77 | 5.24 |
| AD-1615293.1 | 64.80 | 6.40 | 63.00 | 4.34 | 57.01 | 5.52 |
| AD-1615294.1 | 79.46 | 9.80 | 64.65 | 8.74 | 67.12 | 7.59 |
| AD-1615295.1 | 32.90 | 3.78 | 31.10 | 4.78 | 37.75 | 4.21 |
| AD-1615296.1 | 54.83 | 2.43 | 54.74 | 3.67 | 57.69 | 2.44 |
| AD-1615297.1 | 47.71 | 3.24 | 47.85 | 6.18 | 41.30 | 5.80 |
| AD-1615299.1 | 72.63 | 5.56 | 64.43 | 5.83 | 63.38 | 7.44 |
| AD-1466100.5 | 12.13 | 3.73 | 24.66 | 8.07 | 20.91 | 4.13 |
| AD-1615234.1 | 16.07 | 3.29 | 21.79 | 3.13 | 20.46 | 4.71 |
| AD-1615286.1 | 19.68 | 1.30 | 27.22 | 3.50 | 36.20 | 2.70 |
| AD-1615289.1 | 28.25 | 3.55 | 39.71 | 8.59 | 37.39 | 3.39 |
| AD-1615290.1 | 22.37 | 1.35 | 30.79 | 1.95 | 40.82 | 2.36 |
| AD-1615298.1 | 22.81 | 0.97 | 30.37 | 1.11 | 36.70 | 4.61 |
| AD-1466101.2 | 26.98 | 2.47 | 23.42 | 4.98 | 35.30 | 4.13 |
| AD-1615235.1 | 19.00 | 3.18 | 23.35 | 2.86 | 27.73 | 4.91 |
| AD-1615236.1 | 24.35 | 4.69 | 27.01 | 3.59 | 33.01 | 0.11 |
| AD-1615237.1 | 28.84 | 2.32 | 36.73 | 5.29 | 52.08 | 6.15 |
| AD-1615238.1 | 34.08 | 5.24 | 40.58 | 5.54 | 52.89 | 5.38 |
| AD-1615239.1 | 15.55 | 4.08 | 17.08 | 1.04 | 25.33 | 6.07 |
| AD-1615240.1 | 17.40 | 1.16 | 16.52 | 2.36 | 25.24 | 4.61 |
| AD-1615241.1 | 24.05 | 3.61 | 25.31 | 6.24 | 33.44 | 3.61 |
| AD-1615242.1 | 27.18 | 5.81 | 28.38 | 6.73 | 33.29 | 7.02 |
| AD-1615243.1 | 17.15 | 4.90 | 24.65 | 1.31 | 30.22 | 3.88 |
| AD-1615244.1 | 26.63 | 2.64 | 31.35 | 4.83 | 39.94 | 3.89 |
| AD-1466104.3 | 17.51 | 1.71 | 21.62 | 3.16 | 25.75 | 1.80 |
| AD-1466104.4 | 9.51 | 1.22 | 21.91 | 2.81 | 21.97 | 3.69 |
| AD-1615327.1 | 27.07 | 5.33 | 33.19 | 4.79 | 40.32 | 4.99 |
| AD-1615245.1 | 16.23 | 2.49 | 17.17 | 6.32 | 24.15 | 2.42 |
| AD-1615246.1 | 18.50 | 1.44 | 22.65 | 3.84 | 25.38 | 3.39 |
| AD-1615247.1 | 18.44 | 3.56 | 17.79 | 3.52 | 26.69 | 5.95 |
| AD-1615248.1 | 9.27 | 1.48 | 13.51 | 2.64 | 15.36 | 1.27 |
| AD-1615249.1 | 14.91 | 0.83 | 17.76 | 3.75 | 16.04 | 3.73 |
| AD-1615250.1 | 41.95 | 4.99 | 49.08 | 4.22 | 59.19 | 10.96 |
| AD-1615251.1 | 18.75 | 2.29 | 18.80 | 2.09 | 16.50 | 1.03 |
| AD-1615252.1 | 17.16 | 2.57 | 19.49 | 2.85 | 21.88 | 3.63 |
| AD-1615253.1 | 12.18 | 1.97 | 13.92 | 1.62 | 19.52 | 4.74 |
| AD-1466114.4 | 22.38 | 0.98 | 28.53 | 2.62 | 44.86 | 5.45 |
| AD-1615253.2 | 11.09 | 0.39 | 23.05 | 2.53 | 28.97 | 5.20 |
| AD-1615328.1 | 25.46 | 2.10 | 30.19 | 5.39 | 48.55 | 5.01 |
| AD-1615329.1 | 18.00 | 2.07 | 29.35 | 3.44 | 45.88 | 8.47 |
| AD-1615330.1 | 12.28 | 1.04 | 21.69 | 2.50 | 32.09 | 4.96 |
| AD-1615331.1 | 26.69 | 5.11 | 39.59 | 7.06 | 46.73 | 8.67 |
| AD-1615332.1 | 15.69 | 2.64 | 25.35 | 2.65 | 26.26 | 2.38 |
| AD-1615254.1 | 18.85 | 0.62 | 22.39 | 2.46 | 28.03 | 2.37 |
| AD-1615255.1 | 17.57 | 4.67 | 21.59 | 3.07 | 23.17 | 3.45 |
| AD-1615256.1 | 13.59 | 1.54 | 17.80 | 3.60 | 21.95 | 2.51 |
| AD-1466115.2 | 22.34 | 3.17 | 31.58 | 1.68 | 40.98 | 5.49 |
| AD-1615257.1 | 14.42 | 1.10 | 19.93 | 1.27 | 26.92 | 5.78 |
| AD-1466116.2 | 26.58 | 4.75 | 33.30 | 4.95 | 39.77 | 5.85 |
| AD-1615258.1 | 25.03 | 4.09 | 27.69 | 2.84 | 38.18 | 5.49 |
| AD-1615259.1 | 19.53 | 1.57 | 24.17 | 4.73 | 31.07 | 3.87 |
| AD-1466118.3 | 10.82 | 1.71 | 15.07 | 1.30 | 18.07 | 1.39 |
| AD-1615260.1 | 21.14 | 0.82 | 28.23 | 1.76 | 35.08 | 3.87 |
| AD-1466119.3 | 19.29 | 3.36 | 20.98 | 3.70 | 36.60 | 6.73 |
| AD-1615260.2 | 26.16 | 3.28 | 27.11 | 3.36 | 41.53 | 3.41 |
| AD-1615333.1 | 21.43 | 1.52 | 30.81 | 1.69 | 46.49 | 7.39 |
| AD-1615261.1 | 20.18 | 1.97 | 27.94 | 2.98 | 30.40 | 1.63 |

TABLE 12-continued

Coagulation Factor V Single Dose Screens in Primary Human Hepatocytes

| | 10 nM | | 1 nM | | 0.1 nM | |
|---|---|---|---|---|---|---|
| Duplex | Avg % message remaining | SD | Avg % message remaining | SD | Avg % message remaining | SD |
| AD-1466120.2 | 23.67 | 2.32 | 31.97 | 3.22 | 40.33 | 4.12 |
| AD-1615262.1 | 18.19 | 1.50 | 26.40 | 3.71 | 30.38 | 3.77 |
| AD-1466121.3 | 22.16 | 4.20 | 36.47 | 3.98 | 52.73 | 3.89 |
| AD-1615262.2 | 18.29 | 1.06 | 28.20 | 1.61 | 37.47 | 2.66 |
| AD-1615334.1 | 26.20 | 3.20 | 40.07 | 5.51 | 43.08 | 3.68 |
| AD-1615335.1 | 18.49 | 1.58 | 31.04 | 5.05 | 38.00 | 5.34 |
| AD-1615263.1 | 24.20 | 2.99 | 30.15 | 0.49 | 33.36 | 4.58 |
| AD-1615264.1 | 18.44 | 2.08 | 27.76 | 3.99 | 33.93 | 4.44 |
| AD-1615265.1 | 19.44 | 2.58 | 27.39 | 2.63 | 42.95 | 4.48 |
| AD-1615266.1 | 15.52 | 1.86 | 18.50 | 4.38 | 24.88 | 1.62 |
| AD-1615267.1 | 25.59 | 1.37 | 29.33 | 3.43 | 31.63 | 2.44 |
| AD-1615268.1 | 11.99 | 0.80 | 15.26 | 1.55 | 23.34 | 2.65 |
| AD-1466128.3 | 15.21 | 1.17 | 20.79 | 0.93 | 26.59 | 2.54 |
| AD-1466128.4 | 16.20 | 1.33 | 27.80 | 3.07 | 29.68 | 1.73 |
| AD-1615336.1 | 30.06 | 3.48 | 33.61 | 0.42 | 34.88 | 4.69 |
| AD-1615269.1 | 20.60 | 5.45 | 27.78 | 4.39 | 35.30 | 5.97 |
| AD-1615270.1 | 21.28 | 4.32 | 24.30 | 2.85 | 33.43 | 4.39 |
| AD-1615271.1 | 30.04 | 4.73 | 39.89 | 5.10 | 61.97 | 3.27 |
| AD-1615272.1 | 20.91 | 2.48 | 30.00 | 4.76 | 37.93 | 3.53 |
| AD-1615273.1 | 16.57 | 3.56 | 24.24 | 3.42 | 28.05 | 5.71 |
| AD-1615274.1 | 21.86 | 1.17 | 30.42 | 1.92 | 36.50 | 2.58 |
| AD-1615275.1 | 16.20 | 2.69 | 25.78 | 2.05 | 32.41 | 1.60 |
| AD-1458307.1 | 50.25 | 6.41 | 93.34 | 8.38 | 68.75 | 21.39 |
| AD-1615276.1 | 18.70 | 2.80 | 23.82 | 2.47 | 34.61 | 4.43 |
| AD-1466139.3 | 17.76 | 3.09 | 23.49 | 4.19 | 29.19 | 2.03 |
| AD-1615337.1 | 37.55 | 3.14 | 41.43 | 5.33 | 56.33 | 4.51 |
| AD-1615338.1 | 29.12 | 2.65 | 40.54 | 4.48 | 47.77 | 8.73 |
| AD-1466151.3 | 19.08 | 1.43 | 26.91 | 2.70 | 32.55 | 6.09 |
| AD-1615339.1 | 16.72 | 1.03 | 23.82 | 2.85 | 27.13 | 4.58 |
| AD-1615340.1 | 26.06 | 0.67 | 32.17 | 3.25 | 38.62 | 5.61 |
| AD-1615341.1 | 21.65 | 1.89 | 24.76 | 3.96 | 32.37 | 3.35 |
| AD-1466152.3 | 16.42 | 1.84 | 18.28 | 2.33 | 28.16 | 3.13 |
| AD-1615342.1 | 23.27 | 2.06 | 28.91 | 1.56 | 41.76 | 3.51 |
| AD-1615343.1 | 20.33 | 2.32 | 26.10 | 2.30 | 37.86 | 2.77 |
| AD-1459922.1 | 81.25 | 11.77 | 67.16 | 8.31 | 83.60 | 11.52 |
| AD-1615277.1 | 13.01 | 1.26 | 18.11 | 1.55 | 25.55 | 2.72 |
| AD-1414748.1 | 43.51 | 8.48 | 48.30 | 6.56 | 56.75 | 4.45 |
| AD-114469.2 | 21.62 | 1.90 | 30.79 | 7.10 | 39.28 | 1.60 |
| AD-1615278.1 | 13.75 | 2.22 | 16.86 | 1.89 | 18.68 | 4.81 |
| AD-1452126.1 | 109.46 | 11.45 | 99.43 | 16.11 | 118.34 | 15.48 |

Example 5. In Vivo Assessment of RNAi Agents in Non-Human Primates (NHP)

Based on the in vitro analyses described above, duplexes targeting Factor V were selected for pre-clinical pharmacodynamics analysis in non-human primates.

Briefly, on Day 0 male non-human primates (n=3) were subcutaneously administered a single 3 mg/kg dose of AD-1615171; AD-1465920; AD-1615312; AD-109630; AD-1615234; AD-1615253; AD-1615278; AD-109630; or AD-1465922; or a single 20 mg/kg dose of AD-109630; or PBS control (see Table below). At Days 1, 8, 15, 21, and 29, post-dose, plasma samples were obtained and the protein level of Factor V was determined by ELISA. The Factor V ELISA was performed in 96-well format, using affinity-purified antibodies to human Factor V from Affinity Biologicals (Cat. No. FV-EIA)—coating antibody and peroxidase-conjugated capture antibody. An eight point standard curve ranging form 200 ng/ml to 0.685 ng/ml was generated using purified human FV protein (Invitrogen Cat. No. RP-43126). Before adding to wells, cynomolgus monkey plasma samples were diluted 1:1000 in VisuLize™ Buffer Pak from affinity Biologics (Cat. No. EIA-PAK-1), supplemented with bovine serum albumin (BSA) to 6%. The peroxidase activity was measured by incubation with chromogenic substrate 3,3′,5,5′-tetramethylbenzidine (TMB).

Figure 2:
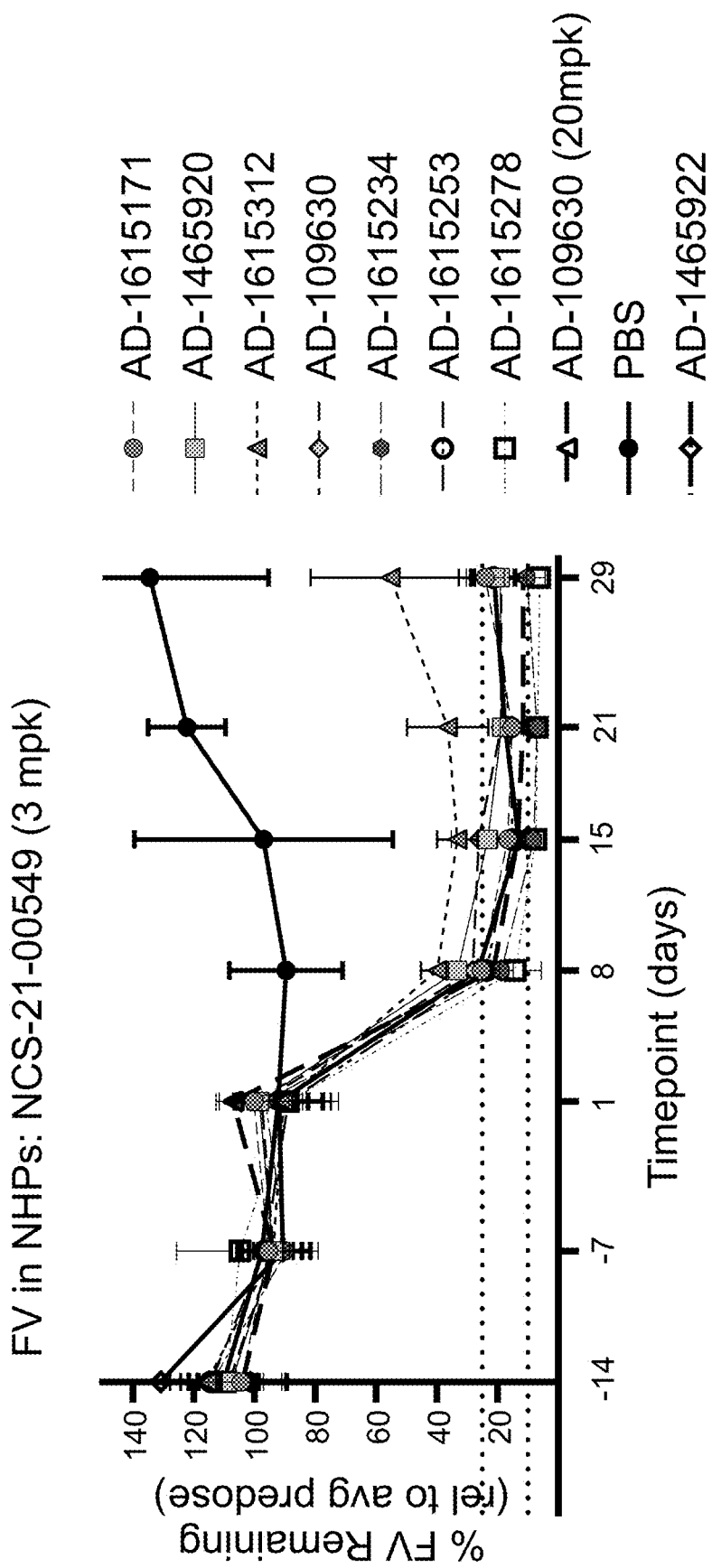
FIG. 2 is a graph depicting the effect of subcutaneous administration of a single 3 mg/kg or 20 mg/kg dose of the indicated duplexes on Factor V (FV) protein levels in the plasma of non-human primates. FV levels are shown as the percent of FV remaining relative to the average pre-dose levels of FV determined on pre-dose Days −14, −7 and 1).
Figure 3:
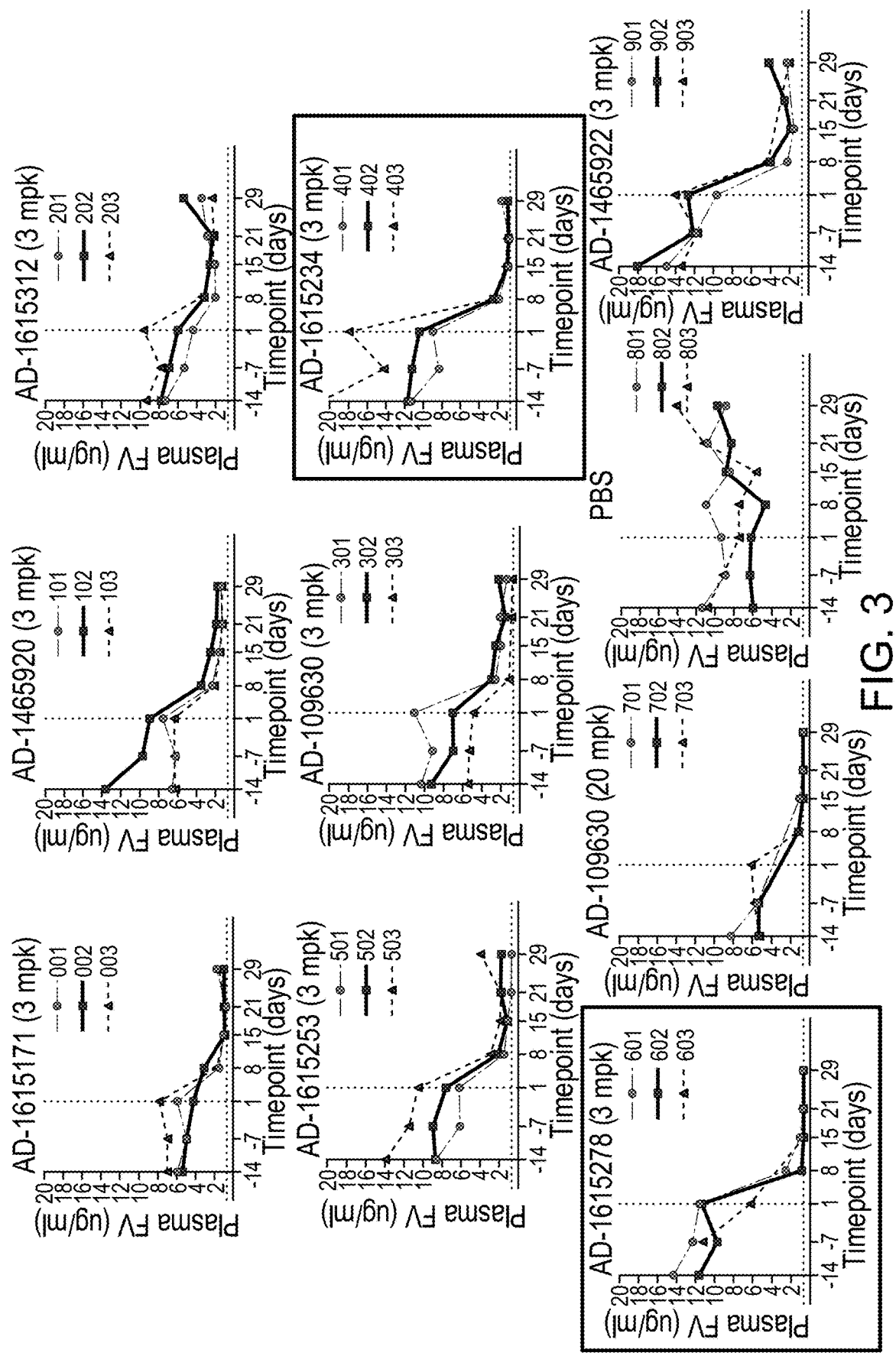
FIG. 3 are graphs depicting the effect of subcutaneous administration of a single 3 mg/kg or 20 mg/kg dose of the indicated duplexes on absolute FV protein concentration in the plasma of non-human primates. FV levels are in µg/ml, The lower limit of quantification (LLOQ) is 0.69 µg/ml FV in plasma (represented as dashed line on the Y-axis).

As depicted in FIG. 2 and FIG. 3, all of the duplexes durably and potently reduced Factor V protein levels in plasma.

| Group | Number of Males | Test Article | Target Dose Level (mg/kg) | Target Dose Concentration (mg/mL) | Target Dose Volume (mL/kg) |
|---|---|---|---|---|---|
| 1 | 3 | AD-1615171 | 3 | 3 | 1 |
| 2 | 3 | AD-1465920 | 3 | 3 | 1 |
| 3 | 3 | AD-1615312 | 3 | 3 | 1 |
| 4 | 3 | AD-109630 | 3 | 3 | 1 |
| 5 | 3 | AD-1615234 | 3 | 3 | 1 |
| 6 | 3 | AD-1615253 | 3 | 3 | 1 |
| 7 | 3 | AD-1615278 | 3 | 3 | 1 |
| 8 | 3 | AD-109630 | 20 | 20 | 1 |
| 9 | 3 | vehicle | NA | NA | 1 |
| 10 | 3 | AD-1465922 | 3 | 3 | 1 |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (3034 sequences)

SEQ ID NO: 1 - DNA, 9179 bp, Homo sapiens
  source 1..9179: mol_type = genomic DNA
gcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatcaggtcattccgaaactcatcattgaatcaggaagaagaagagttcaatcttactgccctagctctggagaatggcactgaattcgtttcttcaaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctatggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcctctctcttcttccagcaacttcccctttcatcattcctttccctggggacttggcattcagtgatcctgtagatattgcacaactggggaacctttagacatccttaaaatcacatgagatagacagtcatttggggtgtctgaaataaaccaccccaaaacttagtgttaaaagagcaaccaaaaaaaatttatgtgagattatggatttgttacttagcttgatttaatcatcctgtaacgtgtacatatatcaaaatgttatgtataccataaatatataaaattttatcaacgaaattcataacaatctctcagaccacagagaaatcaaattagaactgaggactaagaaactcactcgaaaccacacaactacatggaaactgaacaacctgctcctgaatgactactgggtaaataatgaaattaaggcagaaataaataagttccttaaaaccaatgagaacaaagagacaacataccagaatctctaggagacagggctttgcttttgctgcattctattcgttgtgaacacaaattacaggccagtctcgattcagtgtagaagggaactgcataaggaccacataccaggaggcataattcactgggagcatctttagaaactaccagagttacctgttgcccataccagtggggtaagccctatgaatgtatatgagagtttcaaacatccacaaaacattggctttctaatattcgtattcccactattcctttcttttcatgattcatgtcattgtcccatcaacatttctaagatttccattccgttaagagcaaaagagaatgttggaaggtgggggaaaacatttctttgttttctacagggccagcttcttggatgtgtgtgatctgttcagttgcaaagggtcacatgctcagaaggaccgcatgctaaatttaatgctttgcagttaccctcttgaaatcctttattttttaagaaggaattcgacatttccatttttcaatgagccccacaaattacgcagctagtcctgggcttctctactctgaaattgggcaggatctctcttgatctagaatttactaaggcataataggggcaagaaaatcttatgaaataatggggggtagggaagagatgggaatggagcatgagatccagcttcgttattctctacttgagaaaaataaggccccaaagattaaacaacttgcccaaggatattgcttgttagtgtcagaactgaaaccagaaaccaaatgatcatatccctagacttttagtctgctttctcttccataaaatgaaacttataatgtttctaatccattgctcagacaggtagacatgaatattaattgataatgactattaattgatctggaaaatacttgtttggggatcaataatatgtttgggctattatctaatgctgtgtagaaatattaaaacccctgttattttgaaataaaaaagatacccactttt

SEQ ID NO: 2 - DNA, 7433 bp, Mus musculus
  source 1..7433: mol_type = genomic DNA
accacaggggacagggacactcactgtgccctgcagcttcttagtcctccagggagacagatcagcgcgcaacagggacagagcactgagcactgtcggtggtggcagcgcgcggcaggacaagggccatgctcctagtctgcccgtgcttcttcctcctggtggttctgggaacccgctgggcgggctggggcagccaccaggcagaggccgcgcaactaaggcagttctatgtggcagctcaggggatcctctggaactatcatcctgagcccacagatccaagtttgaattctataccttccttcaagaaaattgtctacagagagtatgaacagtattttaagaaagaaaagccacgatctagcaactcaggacttcttggacctactttatacgctgaagttggggacgtcattaaagttcactttagaaacaaagcagacaaaccactaagcatccatcctcaagggattaaatacagtaaattttcagaaggggcttcttacgcagaccacacgttccctgccgagaggaaggatgatgccgtggctcctggagaagaatacacctatgaatggatcgtcagtgaggacagcgggcccacacctgatgacccaccatgcctcacccacatctactattcctatgaaaacctgacccaggatttcaactcgggtctgattgggcctctgcttatctgcaagaaaggcaccctgaccgaggatgggactcagaagatgtttgacaagcagcatgtgctcctatttgctgtgtttgatgaaagcaagagccggagccagtcaccatccctaatgtacacaattaatggctttgtgaataagacgatgccagatataacagtctgtgcccatgaccacgtcagctggcatctgatcgggatgagctcggggccagaattgttttctattcacttcaacggccaagtcctagagcagaaccagcataaagtgtccaccgtcaccctggtcagcgcaacatctacgactgcaaacatgactatgagcccagaaggaagatggattgtttcttctctcatcccaaagcattatcaagctgggatgcaggcttacattgacattaaaaactgcccaaagaaaacgaggagccccaagaccctcactcgggagcagaggcggtacatgaagagatgggagtatttcatagccgcagaggaggtcatttggaactatgcacccgtgatacctgcgaatatggacaaaatttacaggtctcagcacttggataatttctcaaaccaaattggaaaacattacaagaaagttatctacaggcaatatgaagaagagaccttcaccaaacgcactgacaaccccagcatcaaacaaagtgggattctgggccctgttatcagagcccaggtcagagacacactcaagatcgtgttcaaaaatatggcgagccgaccctacagcatttaccctcacggggtgaccttctctccttacgaagatggaatcaattcttcctccacctcaggcagtcacaccacgatcagaccagttcaaccgggggaaaccttcacttacaaatggaacattctagagtttgatgaacccacggaaaacgatgcccagtgcctaacaaggccatactacagtgatgtggacgttacaagggatattgcctctgggctgatagggctgcttctaatttgtaagagcaggtccctggaccagaggggtgtacagagggtggcagacatcgagcagcaggccgtgtttgctgtgtttgacgagaacaagagctggtacattgaggacaacatcaacaagttctgtgagaatcctgatgaggtgaagcgtgatgatcccaagttttacgaatcaaacatcatgagcactatcaacggctacgtgcccgagagcatttccactctgggattctgttttgatgacactgtccagtggcacttctgcagtgtgggaactcatgatgatattttgaccatccacttcactgggcactcgttcatctatgggaggaggcacgaggacaccttgaccctgttccccatgcgtggtgaatctgtgacagttacaatggataatgttggaacttggatgttgaccaccatgaattccaatccaaaacgcagaaacctaagactgagattcagagatgttaagtgtaatcgggattatgacaatgaggactcatatgagatttatgaacctcctgcacctacatccatgacaactcggagaattcatgattccttagaaaatgaatttggcatagacaacgaagatgatgattaccagtacttactggcgtcatcattaggaattaggtcattcaaaaactcatcattgaatccagaggaaaatgagttcaatctcactgctctcgctctggagaacagctctgagttcatatctccaagcacagacagagttgttgactcaaactcttcacgaatccttagtaaaatcatcaataataacctcaaagactttcaaagaacacttcctggctcaggagccaccgtggctggtaccctccttagaaacctcattggcttagatgagaacttcgtcctcaactcttctacagaacatcgttccagctcatatcatgaaaatgatatggaaaatccacagtcaaacatcacaatggtatacctacttcctcttggtccaaaaggatctgggaatcgagaacaagataaacctaaaaccatcaagacaggaagaccccacatgatgaagcacaggttctcctggatgaaagcgccagctggtaaaactgggaggcattcaaacccaaagaattcgtattctggaatgaagtctgaggaggacattcctagcgagttgatacccttaaagcaaaagatcacttccaaatttctgaatagacgatggcgtgtggcttctgaaaagggtagttatgaaataatagcagcaaatggtgaagacacagatgtggataagctgaccaacagtcctcaaaatcagaatatcacagtacctcggggagagagcacctctcacacaaacacaacaagaaagccaagtgacctcccaacattttctggagttggacataaatctccacatgtaagacaggaggaagaaaacagtggttttcagaaaagacagttattcatcaggacacggaagaagaagaaaaataagaagcttgcactacacagtcctctatctccaaggggctttgaccctttgagaggacataaccattccccatttccagacaggagactacttaatcactcactgttactccacaagtccaatgaaacagctctttctccagacctgaaccagacctctccttcaatgagtacggacaggtcacttcctgactataatcagtactcgaaaaatgacactgagcagatgagctcttctttagatctttatcagtcagtgcccgcagaggaacactctccaacatttcctgcccaagatcctgatcaaacacactctaccacagatcctagctacagatcctctccgccagagctcagccaggggcttgattatgacctaagtcatgacttttaccctgatgacattggtctaacatctttctttccagaccaaagtcaaaagtcatctttctcttcagatgatgaccaagcaatcccttcctcagacttaagcctctttaccatctctccagaattggatcagacaattatttacccagacctggatcagttgctcctttctccagaagacaatcagaagacctcctccccagacctgggccaggtgcccctttctccagatgacaaccagaagacctcctccccagacctgggtcaggtgtccctttctccagatgataaccagaagacctcctccccagacctgggtcaggtgcccctttctctagatgacaaccagaagacgacctccccagacctgggtcaggtgcccctttctccagatgacaaccagatgatcacctccccagacctgggtcaggtgcccctttcttctgataaccagaagacctcttccccagatctgggtcaggtgcctctttttcctgaagacaaccagaattacttcctagacctgagtcaggtacctctctcctcagaccaaaaccaggagacctcctccacagacctactgactctctctcctgattttggtcagacagtcctttccccagacttggatcagctgccactcccttcagacaatagtcaggtgaccgtttccccagacctcagcctcttgaccctctcaccagattttaatgagataatcctagccccagaccttggtcaagtgaccctctctccagacctcatccagacaaaccctgctcttaatcatggacacaaagcatcctctgcagaccctgatcaagcatcctaccctccagattctggtcaggcttcatcgcttccagaactgaatcggactcttcctcatccagatctcactcacataccacctccttcaccatctcccacactcaataacacttctttgtcaaggaaatttaaccctcttgttgtagtaggtctcagtagagtagatggagacgacgttgagattgttccaagtgaggagccagagagaatagatgaagattatgccgaggatgactttgtaacctataatgacccctacagaacagacactaggacagatgtcaattcctccagaaatcctgacactatcgcagcatggtacctccgaggccacggtggacacaaaaaattctactatattgcagctgaagaaataacctggaattacgcagagtttgcacaaagtgaaatggaccatgaagacacaggccacactccaaaggacaccacatacaagaaagtcgttttcagaaaataccttgatagcacgtttacaagtcgtgatcctcgggcagaatatgaggagcaccttggcattctcggtcctgtgatccgggctgaagtggatgatgtgatccaagttcgatttaaaaatttggcatccagaccgtattctcttcatgctcacggactttcctatgaaaaatcctcagaggggaagacttatgaagatgaatctcctgaatggtttcaggaagatgatgctgtccagcccaatagcagttacacctatgtatggcatgccaccaagcgctcagggccagagaaccctggttctgcctgccgggcttgggcctactattctgcagtgaatgtggagagggacatccactcaggcttgatcggcccccttctgatctgccggaaaggaacacttcacatggagcgcaacctgcctatggacatgagagagtttgtcttactcttcatggtctttgatgagaagaagagctggtactatgaaaagtccaaggggtcacggagaattgaatccccagaagagaaaaatgcccacaagttttacgcaattaatgggatgatctacaacctgcccggcctgagaatgtacgagcaagagtgggtgaggctacacctgctgaacatgggcggctcccgagatattcacgtggttcacttccatggccagaccctgctggataataggaccaaacagcaccagttaggcgtctggccccttctgcctggttcatttaaaactcttgaaatgaaggcatccaagcctggctggtggctcctagacacagaggttggagaaaaccaggtagctggcatgcaaacgccatttctcatcatagacaaagagtgtaagatgccaatgggactaagcactggtgtcatatctgattcacagatcaaggcttcggaatatctgacttattgggagcccagattagcacgattaaacaatgctggttcatacaatgcttggagtatagaaaaaactgcattagattttcccattaaaccttggatccaggtggacatgcagaaggaagttgtagtcaccgggatacaaacccaaggtgctaaacactacctaaagtcctgctttaccacggagttccaagtggcttacagctctgaccaaaccaactggcagatcttcagagggaagagcgggaagagcgtgatgtattttactggtaattcagatggctctacaataaaagagaatcgacttgacccacccattgtggctagatacattaggatacacccaacaaaatcctataatagacccacccttcggctggagctgcagggctgtgaggtgaacggatgttccacaccactgggcctggaagatggacggattcaagacaagcaaattactgcatcttcatttaaaaagtcgtggtggggagactactgggagccctcccttgcccgcctgaacgcccagggccgcgtgaacgcctggcaagccaaggcaaacaacaacaagcagtggttacaagtcgatctgctcaaaatcaagaaggtaacggccatcgtaacgcagggctgtaagtctctgtcctctgagatgtacgtgaagagctacagcatccagtacagtgaccagggtgtggcatggaaaccttaccgacagaaatcctccatggtggacaagatttttgaaggaaacagcaataccaaggggcacatgaagaactttttcaacccgcccattatttccagatttatccgcatcattcctaaaacatggaaccagagcatcgcccttcgcctagagctcttcggctgtgacatttattagaattaaattccaaaaagagaaaaaaaaaggaaaagagagaataaaagctgaagaaactccttcaagcctaaaccatttagagcaggccctatagcatgggtattttaaatgttaacagaagttctgctatttttttctagttgagaataagctttatgtgagaagcttttaatactccttcatcgctgccactaagtgagatggcagctattatttcttcactgatttgaatataaatggggaaatattaagacctggcaagaatatgactgtttttcactctgattaaagacattgtataatataatagttatataatggaatgatatgattcactgtggctctttgaaatcctgtagacattagcaaaagataatacttttggaaatttttcatggacctagaaagcctttctttctatatttttcttttaaaagcaaactgtaatttgtaaacaatagaaacaaaagtagttgaggttttttttttatcatagagaaaaatatatcttgttgtaattaagtgagaacttaaaaatacccagtgttgggctggctcagtgggcaaaagtgcttgctgccaaaacaaaacaacaacagcaacacaacacaaaacaaaccttatggcttgagttcaagtcctggaacccacagtgaaaggagagagcatattccagaaagccgtcccctggtttctgcatgacccacgaccatgtacaagcactaacggtaaataaaagatttttaaagcttg

SEQ ID NO: 3 - DNA, 6315 bp, Rattus norvegicus
  source 1..6315: mol_type = genomic DNA
atgcaaagctcagaaggtcaagtccaagagaagcaggcggagatccggaggagtgacaaaaatcatgtcggggcctttctatatgttcctctatatgtctttcatgatcttgaatataaacaatttcaaacctatccttccttaggacttctcggaccaactttatatgctgaagttggcgacaccatcaaggttcactttagaaacaaagcagacaaacctctaagcatccaccctcaaggaattagatacagcaaattttcagaagctcagctgtttgcggaggaggaaatggactttgcagcaccattcatcctccttcgatgtttatttgaccctccctcactcagtcagcaagcattggttcttcttccaaaacggaagactggtttctacgtcacccctctactcctggagggagtgcccggtgttcataggttgtcaatgggtctttacacaatgaagcgaggcatcttcaccctgggacagactggcttcatgtgcccaaggagtaggctgcatgcaggagctggatgtggagaccgcaggggtggggaagagccagaaagagctagcgcatcaccctttctccacactggcgagtggtggaaaactctggatgtctttgtggcggtcacttctccaggggcttcttacctggaccacacatccccggctgagaggaaggacgatgctgtggctgctggagaggaatacacctatgaatggttcatcggtgaggacagcgggcccacacctgatgacccaccatgcctcacccacatctactactcctatgaaaacctgacccaggatttcaactcaggcctgattgggcctctgctcatctgcaaggaaggcaccctgactgaggatgggactcagaagatgtttgacaagcaacacgtgcttctgtttgctgtatttgatgaaagcaagagctggagccagtcaccagccctcatgtacacagtcaacggctttgtgaataggacaatgccagatgtaacagtctgtgcctacgatcatgtcagctggcatctgattgggatgagctcgggaccagaattgttttctattcacttcaacggccaagtcctagagcagaaccaacataaagtgtccaccgtgactctgctgcagactgtaggcatctttatccgaccaatagctttaaatactgtgcaaggttacatagcatcccgtggtgaggatctccttgtcccttgggcaaccagagctgctgggatgcaggcttatattgacattaaaaactgcccaaagaaaaccaggagctccaagacgctcacccgagagcagcggcggcacatgaagaggtgggagtacttcatcgccgcagaggaagtcatttggaactacgcacctgtgatacccgcaaacatggacaagcattcttatccactaagtcccatgggaatgtggcctgatgatagtaacaggaacaatggcagtagaatgctagctactgttaacccttgtagtaggtgtttgctaaggctgtcacatcagttctacaagctaggtgctattcttgtgttcttgtatctaagggaaggtgccagaaaatcggaagctctagtagttcgccatatgccatttctaagggtagcagacatggagcaggaggtcgtgtttgctatgtttgatgagaacaagagctggtacatcgaggacaacatcaacaagttttgtgagaatcccgatgaggtgaagcgtgatgaccccaagttttatgaatcaaacatcatgaacactatcaatgggtacgtgcctgagagcatatccaccctaggattctgttttgatgatgccgtacagtggcacttctgcagtgtgggaactcatgatgacattctgaccgtccacttcactgggcactcattcatctatgggaggaggcacgaggacaccttgaccctgttccccatgagtggtgaatctgtgactgtcgtgatggataatattggaacttggatgttgaccaccatgagttccaatccaagacgcagaaacctaagattgagattcagggatgttaagtgtaaccggaatgatgatgacgatgaagactcatatgagatttatcaacctcttgaacctacatccatgacaactcggaaaattcatgattctgtggaaaatgactttggcatagaaaacgaagatgatgattaccagtacgaactggcgtcaacactaggaattaggtcattcagaaagtcattgttgaatccgaaggaagacgagttcaatctcactgctctcgctctagaaaacagctctgaattcatatctctaagcacagacggagttgttgactcaaaatcctcaagaaaccttagtaagatcaccaataataacctcaacgactctcaaagaacactttctggctcaggagccaccatagctggtatcctacttggaaaccttactggcttaggtaagaactccgtcctcaacccttcaacagaatatcattccagctcatattatgaaaatgatatggaagacccacagtcgaacatcacagtggtatacctacttcctcttggtgcaaaaggatcagggagtcgagaacagactaaacctaaaacaatcaagacaggaagaccccacaggatgaagcacaggttctcctggatgaaagctccagccggaaaaactgggaggcattcaaatccaaagaatacttcttccagaatgaagtctgaggaggacattcctagtgatttgttactcttaaaacaaaaggtcgcatccaaacttttgaacagacagtggcatatggcttctgaaaagggtagttatgaaataataccagcaaatggtgaaaacacagatattgataagctgacaaacagtcctcaaaatcagaatatctcaacgccttggggagctagcacctctcgcataaacacgacagggaagccaagtaacctcccaacattttctagatttaggcataaatctccacatgtaagacaggaggaggaaagcggtgactttaagaaaagacagttgttcatcaggacacggaagaagaagaagaacaggaaaagactactcaatcattcattactactccacaaatccaatgaaacagctctttccacagatctgaatcagacctcccctccagtgagtactgacaggtcacttcctgactataatcagaacccttcaaatgatactgagcagatgagctcttctttagacctttttcagtcagtgccaccagaggaacactctccaacatttcctacccaagatcctaatcaaacacactctaccacagatcctagctacagatcctctcctccagagcccagtcaagggatcgattatgacctaagccatgaattttattctgatgacattagtcaaacatctttctttccagaccaaagtcaaaagtcacctctcacttcagatgatggccaagcaatcccttcctcagacttaaatctctttaccatctctccagaattggatcaaacaattatttacccagacctggatcagttgttcctttctccagatgacatccagaagacctcctcccaagacctgggtcaggtgaccctttctccagatgaaaaccaagagacctcctcccaagacctgggtcaggtgaccctttctccaaatgaaaaccaagagacctcctcccaagacctgggtcaggtgaccctttctccagatgacatccaggagacctcctcccaagacctgggtcaggtgaccctttctccagatgaaaaccaagagacctcctccccagacctgggtcaggtgccccttaccccagatgacaaccagaagacttccccagacctaggtcaggtgctcctttctctagatgacaagcagaagacttacttcctagacccaggtcaggtacccatctcctcagaccaaagctgggagacctcctccactgaccttagcctactgactctctctccgaaatttggtcagacagtcatttccccagacttggataagatgcccctctcttcagacaacagtcaagttaccctttccccagacctcagcctcttgaccctctcaccagattttaatgagataatactatccccagacattgatcaggtgaccctctctccagacctcatccagacaagccctgctcttaatcacaggcacaaaacatcctctgcagaccctggtcaagcatcctaccccccagattctggtcagtcttcacctcttccagaactgaatcagactcttcctcatccagacctcattcacatgcagcctcctttactatctcccacacctaatgacacttctttgtcaaagacatttaacccccttgttgtagtaggtctcagtagagttgatggagacgatgttgagatgattccaagtgaggagctagagagcattgacgaagattatcctgaggatgactatgtaacctacaatgacccctacaaaacagacaccagggcaaatgtcaactcctccagaaaccctgacactattgcagcatggtatctccgtagcttcggtgggaacaaaaaattctactatattgctgctgaagaaatatcctgggattattcaaaatttgcaccaagtgaaatggacaatgaagaaacagacaacactccaaaggacaccacatacaagaaagttgttttcagaaaataccttgatagtactttcacaagccgtgatcctcagggggaatatgaggagcaccttggcattcttggccctgtaatacgtgctgaagtggatgatgtgatccaagttcgatttaaaaatttagcatccagaccatattctcttcatgcccatggactttcctatgaaaagtcctcagagggaaagaattacgaagatgactctcctaaatggtttcaggaagatgatgctgtccagcccaatagcagttacacatatgtatggcatgccactgagcgcgcgggaccagagaaccccggttctgcctgccgggcttgggtctactattctgcagtggatgtggagcgagacatccactcaggcttgatcggcccccttctgatctgccggaaaggaacacttgacagggcgagcaacctgcctctggacatgagagagtttgtcttgctcttcatggtctttgatgagaagaagagctggtactatgaaaagtccaaagggtcatggagaattgaatctccagaagcgaaaaattcgcacgagttttacgcaattaatgggatgatttacaacctgcccggcctgagaatgtatgagcaagagtgggtgaggctgtacctgctgaacatgggcggcccccaagatattcacgtggttcacttccatggccagatcctgctggataataggaccaaacagcaccacttaggggtctggcccctcttgcctgagtgcaagatgccaatgggtctaagtactggtgccatatctgactcacagatcaaggcttcagaatatctgagctgccttggaggacatgctagaggactgacagaccctgtctggtactccatgagcccagacaagattcctagatcattcctcattcccaggctcctccccaaagaaaaatattcaaatgcagagagcctgtctgtcatcattgtgcaaaccaccttgagtctgtttctcttggtactttattcttttgctggcaattcagatgcctctacgataaaagagaatcgatttgacccacctattgtggctagatacattaggatacatcccacgaaatcctataacagacccacccttcggttggagctgttgggctgtgaggtgaacggatgctccacaccactgggcctggaagatggaaggatacaaaacaagcaaattactgcatcttcatttaaaaagtcatggtggggaagctactgggagccttcccttgcccgcctgaatgcccagggccgagtgaatgcctggcaagccaaggcaaacaacaacaagcagtggttacaaattgatctgctcaaaatcaagaaggtaacggccatcgtaactcagggttgcaagtctctgtcctctgagatgtatgtgaagagctacagcatcctgtacagtgaccagggtgtctcctggaaaccctaccggcagaaatcctccatggtggacaagatttttgaagggaatagcaataccaaagggcatatgaagaactttttcaacccacctattatttccagatttatccgaatcattcctaaaacatggaaccaaagtattgcacttcgcctggaactcttcggctgtgacatttattagaataaa

SEQ ID NO: 4 - DNA, 6936 bp, Macaca fascicularis
  source 1..6936: mol_type = genomic DNA
ctgggagctgtgatctcaccaagcccctgccaggaaaagccccagaaaaaggggagggagggagaggcagaggctgccgctgcagtttgcaagaaccgcaggggagaaggacgctgccacccacagccttcagagctcattgcagctgggacagccaggagcggggttagtcagcagctcgacgagcggctgcccaggtcctggggtggtggcagccagcgggagcaggaaaggaagcatgttcccacgctgcccacgcctctgggtcctggtggtcttgggcaccagctgggtaggctgggggagacaagggacagaagcggtacagctaaggcagttctacgtggctgctcagggcatcagttggagctaccgacctgagtccacaaactcaagtttgaatctttctgcaacttcctttaagaaaattgtctacagagagtatgaaccatattttaagaaagaaaaaccacaatctagcatttcaggacttcttgggcctactttatatgctgaagtcggagacaccataaaagttcactttaagaataaggcagataagcccttaagcatccatcctcaaggaattaggtacagtaaattatcagaaggtgcttcttaccttgaccacacattccctgtggagaagatggatgatgctgtggctccaggccgagaatacacctatgaatggagtatcagtgaggacagcgggcccacccatgatgaccctccatgcctcacacacatctattactcccatgaaaatctaatcgaggatttcaactctggactgattgggcccctgcttatctgtaaaaaagggatcctaactgaggatgggaaacagaagacgtttgacaagcaaatcgtgctactgtttgctgtgtttgatgaaagcaagagctggagccagtcatcatccctaatgtacacagtcaatggatacgtgaatgggacaatgccagatataacagtttgtgcccatgaccacatcagctggcatctgctgggaatgagctcggggccagaattgttctccattcatttcaatggccaggtcctggagcagaaccatcataaggtctcagccatcacccttgtcagtgctacatccactaccgcaaatatgaccgtgggcccagagggaaagtggatcatatcttctctcaccccaaaacatttgcaagctgggatgcaggcttacattgacattaaaaactgcccaaagaaaaccaggaatcctaagaaaataactcgtgagcagaggcggcacatgaaaaggtgggaatacttcattgctgcagaggaagtcatttgggactatgcacctgtaataccagcgaatatggacaaaaaatacaggtctcagcatttggataatttctcaaaccaaattggaaaactttataagaaagttatgtacacacagtacgaagatgagtccttcaccaaacgtacagtgaatcccaatatgaaagaagatgggattttgggtcctattatcagagcccaggtcagagacacactcaaaatcgtgttcaaaaatatggccagccgcccctatagcatttaccctcatggagtgaccttctcaccttatgaagatgaagtcaactctactttcacctcaggcaggaacaacaccatgatcagagcagttcaaccaggggaaacctatacttataagtggaacatcttagagttcgatgaacccacagaaaacgatgcccagtgcttaacaagaccatactacagtgacgtggacatcatgagagacatcgcctctgggctaataggactacttttaatctgtaagagcagatccctggacaggcgaggaatacagagggcagcagacatcgaacagcaggctgtgtttgctgtgtttgatgagaacaaaagttggtaccttgaggacaacatcaacaagttttgtgaaaatcctgatgaggtgaaacgtgatgaccccaagttttatgaatcaaacatcatgagcactatcaatggctatgtgcccgagagcataactactctcggattctgctttgatgacactgtccagtggcacttctgtagtgtggggacccagaatgaaattttgaccatccacttcactgggcactcattcatctatggaaagaggcatgaggacaccttgaccctcttccccatgcgaggagaatctgtgacggtcacaatggataatgttggaacttggatgttaacttccatgaattctagtccaagaagcaaaaagctgaggctgaaattcagggatgttaaatgcattacagatgatgatgaagactcatatgagatttttgaacctccagaatctacagtcatagctacacggaaaatgcatgatcctttagaaactgaagatgaagagagtgacactgactatgattaccagagcagactggctgcagcattaggaattaggtcattcagaaactcatcattgaatcaggaagaagaagagtacaatcttactgccctagttctggagaatggcactgaattcatttcttcgaacacagatataattgttggttcaaattattcttccccaaataatattagtaagctcactgtcaataattttgcagaacctcagaaaaccccttctcaccgacaagccaccacagctggttccccactgagacacctcactggcaagaactcagttctcaattcttccacagcagagcattccagcccttattctgaagaccctatagaggatcctctacagccagatgtcacagggatacatctactttcacttggtgctagagaattcaaaaatcaagaacatgctaaacgtaagggacccaaggtagaaagagaccaagcagcaaagcacaggttctcccggatgaaattactagcacataaagttgggagacacctaagccgagacactggttctccctccagagtgaggccctgggaggaccttcctagtgatctgttactcttaaaacaaaataactcatctaagattttggttgggagatggcatttggcttctgagaaaggtagctatgaaataatccaagatactgatgaagacacagctgttaacaatcgactgatcagcccccagaatgcctcacgtgcttggggagaaagcacccctcttgccaacaagcctggaaagcagagtggccacccgaggtttcctagagttagacataaatctctgcaagtaagacaggatggaggaaagagtggactaaagaaaagtcagtttctcattaagacacgaaaaaagaaaaaagagaagcgtacacaccatgctcctttatctccaaggacctttcaccctctaagaactgaagcctacaacacattttcagaaagaagacttaaccattcattgttgcttcataaatccaatgaaacatctcttcccaaagacctcaatcagacattgccctctatggattttagctggatagcctcacttcctgaccataatcagaattcctcgaatgatactcgtcagacaagctctcctccagatctttatcagacagtgcccccagaggaacactatgaaacattccccattcaagaccctgatgaaatgcactctacttcagaccccagtcacagatcctctgctccagagctcagggagatgcttgagtatgaccgaagtcacaagtccttccccactgatataagtcaaatgtccccttcctcagaacgtgaagtctggcagacagtcccctctgcagacctcagccaggtgaccctctctccacaactcagccaaacaaacttctcgccagacctcagccacacgactctctctccagaactcagtcagacaaacctttccccagccctcggtcagatgcccatgtctccagacctcagccatacaaccctttctccagacctcagtcatacaaccctttctccagacctcagccatacaaccctttctccagacctcagtcctacaaccctttctccagacctcagtcatacaaccctttctccagacctcagtcacacaaccctttctccagacctcagtcctacaaccctttctccagatctcagtcatacaatcctttctccagacctcagtcctacaaccctttctccagacctcagtcatacaaacctctctccagacctcagtcatacaaccctttctccagacctcagtcagacaaacctttccccagccctcggtcagatgcccatgtctccagacctcagtcatacaaccctttctccagacctcagtcatacaaacctctctccagacctcagtcatacaaccctttctccagacctcagccagacaaacctctctccagaactcagtcatacaaacctttccccagccctcggtcagatgcccctttctccagacctcagccaggtgactgtctctccagacatcagtgagaccacccttctccctgatctcagccagatatcacctcctccagaccttgatcagacattctacccttctgaatctagtcagttattgcatcttccagaatttaatgagacttttccttatccagaccttggtcagatgccatctccttcatctcctactctcaatgatacttttctatcaaaggaatttaatccactggttatagtgggcctcagtaaagatggtacagattacattgagattattccaaaggaagaggtccagagcagtgaagatgactatgctgaaattgattatgtgccctatgatgacccctacaaaactgatgttaggacaaacatcaactcctccagaaatcctgacaacattgcagcatggtacctcctccgcagcaacaacggaaacagaagaaattattacattgctgctgaagaaatatcctgggattattcagaatttgtacacagggaaacagatattgaagactctgatgatattccagaagacaccgtatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccatattctctacatgcccatggactttcctatgaaaaatcatcagagggaaagacttatgaagatgactctcctgaatggtttaaggaagacaatgctgttcagccaaatagcagttatacctacgtatggcatgccactgaacgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgaccttcgatgaaaagaagagctggtactatgaaaagaagtcccgaagttcttggagactcacatcctcagaagtgaaaaaatcccatgagtttcacgccattaatgggatgatctacagcttgcctggcctgagaatgtacgagcaagagtgggtgaggttacacctgctgaacataggcggctcccaagacattcacgtggttcactttcatggccagaccttgctggaaaatggcaataaacagcaccagttaggggtctgggcccttctgcctggttcatttaaaactcttgaaatgaaggcatcaaaacctggctggtggctcctaaacacagaggttggagaaaaccagagagcagggatgcaaacgccatttcttatcatggacagagactgtaagatgccaatgggactaagcactggtatcatatctgattcacagatcaaggcttcagaatttctgggttactgggagcccagattagcaagactaaacaatggtggatcttataatgcttggagtgtagaaaaacttgcagcagaattggcctctaaaccttggatccaggtggacatgcaaaaggaagtcgtaatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaacccgagcctataacagacctacccttcgattggagttgcaaggttgtgaggtaaatggatgttccacaccgctgggtatggaaaatggaaagataggaaacaagcaaatcacagcttcttcgtttaaaaaatcttggtggggagattactgggaacccttccgtgcccgtctgaatgcccagggacgtgtgaatgcctggcaagccaaggcaaacaacaacaagcagtggctagaaattgatctactcaagatcaagaagataacagcaattacaacacagggctgcaagtctctgtcctctgaaatgtatgtaaagagctataccatccactacagtgaccagggagtggaatggaaaccgtacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatgtttactagaactgaatattcaaaaacccctggaagagggtctttaagacctcaaaccatttagaatgggcaatgtatttacactgtgttaaatgttaacagttttccactatttctctttttttctattagtgaataaaattttatacaagaaggtttta

SEQ ID NO: 5 - DNA, 9179 bp, Homo sapiens
  source 1..9179: mol_type = genomic DNA
aaaagtgggtatcttttttatttcaaaataacaggggttttaatatttctacacagcattagataatagcccaaacatattattgatccccaaacaagtattttccagatcaattaatagtcattatcaattaatattcatgtctacctgtctgagcaatggattagaaacattataagtttcattttatggaagagaaagcagactaaaagtctagggatatgatcatttggtttctggtttcagttctgacactaacaagcaatatccttgggcaagttgtttaatctttggggccttatttttctcaagtagagaataacgaagctggatctcatgctccattcccatctcttccctaccccccattatttcataagattttcttgcccctattatgccttagtaaattctagatcaagagagatcctgcccaatttcagagtagagaagcccaggactagctgcgtaatttgtggggctcattgaaaaatggaaatgtcgaattccttcttaaaaaataaaggatttcaagagggtaactgcaaagcattaaatttagcatgcggtccttctgagcatgtgaccctttgcaactgaacagatcacacacatccaagaagctggccctgtagaaaacaaagaaatgttttcccccaccttccaacattctcttttgctcttaacggaatggaaatcttagaaatgttgatgggacaatgacatgaatcatgaaaagaaaggaatagtgggaatacgaatattagaaagccaatgttttgtggatgtttgaaactctcatatacattcatagggcttaccccactggtatgggcaacaggtaactctggtagtttctaaagatgctcccagtgaattatgcctcctggtatgtggtccttatgcagttcccttctacactgaatcgagactggcctgtaatttgtgttcacaacgaatagaatgcagcaaaagcaaagccctgtctcctagagattctggtatgttgtctctttgttctcattggttttaaggaacttatttatttctgccttaatttcattatttacccagtagtcattcaggagcaggttgttcagtttccatgtagttgtgtggtttcgagtgagtttcttagtcctcagttctaatttgatttctctgtggtctgagagattgttatgaatttcgttgataaaattttatatatttatggtatacataacattttgatatatgtacacgttacaggatgattaaatcaagctaagtaacaaatccataatctcacataaattttttttggttgctcttttaacactaagttttggggtggtttatttcagacaccccaaatgactgtctatctcatgtgattttaaggatgtctaaaggttccccagttgtgcaatatctacaggatcactgaatgccaagtccccagggaaaggaatgatgaaaggggaagttgctggaagaagagagaggaggaagttgaggccatagagaggaaggccctgaaagaaaactttaactgcttgccagtttggccagaggtctctttgagcaggaacaactgcatttagaccagcagttcccatgctctgttttacaggtctgagctttccagtaggtgaaattatgttttgaaactgtgtgccatgtagtaccagctagaataaagccaacattacacattcagttctaccatggttatttcagttctgttccatatctaatgaccaccaaccttgaatatcaatgtgtgcagtccttagggagaccaggacggattcacaatttcaatggggctactggaaagatgcttggctgtttttttactcatggaaagtcagaaaaatcattgttatatgggaaagacaggatattttaagtacttatttcatttgataatattgtttttctcttcactcaagaaaaaccattaaaaaatcatgtgtttgtgaaagttatccaggtctatcaattattatttaaagtaatatctgttttactagtgtgtaaaggatttaaaagagttataatgaagcattttaactacataaatattacttcatagcattttcaatcattaagaaagataagcccttttcttgttggttcttgatattttcctacctgtattcaaattaatgcagaagtaatagccattatcttacttactggtagcaaggagttacattataaaagcttcttgtataaaattttattcactaatagaaaagaaagagaaatagtggaaaactgttaacatttaacacagcgtaaaatacattgcccattctaaatggtttgaggtcttaaagagtctcttccaggggtttttgaatgttcaattctagtaaatatcacagccaaagagttccaggcgaagtgcaatactttgattccatgttttaggaatgacacggataaacctggaaatgattggggggttgaaaaagttcttcacatgtcctttggtattagtatttccttcaaaaatcttgtccaccatggaggatttcagcctgtatggtttccattccactccctgctcactgtagtggatggtatagctctttacatacatttcagaggacagagacttgcagccctgtgttataattgccgttatcttcttgatcttgagtagatcaatttctagccactgcttattgttgtttgccttggcttgccaggcattcacacgtccctgggcattcagacgggcacggaagggttcccagtaatctccccaccaagatttcttaaacgaagaagctgtgatttgcttgttttctatctttccattttccatacccaggggtgtggaacatccatttacctcacaaccttgcagttccaatcgaagggtaggtctgttataggctcgagttggagagatcctaatatatctagccacaataggtgggtcaaactgattctcttttattgtagaggcatctgaattgccattaaaatacatcacattccttgtgctgttccctttgaagatctgccagttgatctggttggaactgtaagctacatagaactctgtggtatagcaggacttcaggtagtgtttggcaccttgggtctggatccctgtgattatgacttccttttgcatgtccacctggatccaaggtttagaggcaaattctgctgcaagtttttctacactccaagcattataagatccaccattgtttaatcttgctaatctgggctcccagtaacccagaaactctgaagccttgatctgtgaatcagatatgataccagtgcttagtcccattggcatcctacagtctctgtccatgataagaaatggcgtttgcatccctgctctctggttttctccaacctctgtgtttaggagccaccagccaggttttgatgccttcatttcaagagttttaaatgaaccaggcagaaggggccagacccctaactggtgctgtttattgccattttccagcaaggtctggccgtgaaagtgaaccacgtgaatgtcttgggagccgcctatgttcagcaggtgtaacctcacccactcttgctcatacattttcaggccaggcaagctgtagatcatcccattaatggcgtgaaactcatgggattttttcatttctgaggatgtgagtctccaagaacttcgggacttcttttcatagtaccagctcttcttttcatcaaaggtcataaatagtaagacaaattctctcatgtccataggcatgttgctgtccttatgtagtattcctttttggcagattaggaggggacctatcaagcctgagtgaatatctttttctgggttcacagctgagtagtaggcccaagcccgacaggcagagccaggactttctggccctgatcgctcagtggcatgccatacgtaggtataactgctatttggctgaacagcattatcttccttaaaccattcaggagagtcatcttcataagtctttccctctgatgatttttcataggaaagtccatgggcatgtagagaatacggtctggatgctaaatttttaaaacgaacttggataacatcatccacttcagctctgataataggaccaagaattccgagatgctcttcatactcccctcgaggatcacgtttggtaaaagtgctgtcgaggtactttcgaaaaactactttcttatatgtggtatcttctggaatatcatcagagtcttcaatatctgtttccctttgtacaaattctgaataatcccaggatatttcttcagcagcaatgtaataatttcttctgtttccattgttgctgcggaggtaccatgctgcaatgttgtcaggatctctggaggagttgatgtttgtcctaacatcagttttgtaggggtcatcatagggcacataatcaatttcagcatagtcatcttcactgctctggacctcttcctttggaatgatctcaatgtaatctgtaccatctttactgaggcccactataaccagtggattaaattcctttgatagaaaagtatcattgagagtaggagatgaaggagatggcatctgaccaaggtctggataaggaaaagactcattaaattcttgaagaagcaatgactgactagattcagaagggtagaatatctgatcaaggtctggaggaggtgatatctggctgagatccgggagaagggtggtgtcactgatgtctggagagagagtcacctggctgaggtctggggaaagggacatctgaccaaagtttggggaaagatctgtctcaccaaggtctggagaaagtgtcatctggtcgaggtctggggtaaggggaatttgactgagatctgcaaagaggggcatctcactgaggtctggggaaaggtttgtctgactgagttctggagagaggtttgtctggctgaggtctagagaaagggttgtatggctggggtctggagaaaggggcatctgaccgagggctggggaaaggtttgtttgactgagttctggagagaggtttgtctggctgaagtctagagaaagggttgtatggctgaggtctggagaaatgggcatctgaccgagggctggggaaaggtttgtctgactgagttctggagagagagtcatatggctgagttctggagagaggtttgtctggctgaagtctagagaaagggttgtatggctgaggtctggagaaaggggcatctgaccgagggctggagaaaggtttgtctgactgagttctggagagaggtttgtctggctgaggtctaaagaaagggttgtatggctgaggtctggagaaagggttgtatggctgaggtctggagaaatgggcatctgaccgagggctggggaaaggtttctctgaatgagttctggagagagagtcgtgtggctgaggtctggagagaggtttgtctggctgagttctggagagagggtcacctggctgaggtctggagagatgactgtctgccagacttcatgttctgaggaaggggacatttgacttatatctgtggggaaggacttgtgacttcggtcatactcaagcatttcactgagctctggagaagaggatctgtgactggggtctgaagtagagtgcatttgatcagggtcttgaatggggaatgtttgatagtgttcctctgggggcactgtctgataaagacctggaggacagcttgcctgaccagtgtcatttgaggaattctgattatggtcaggaagtgaggctatccagccaaaatccatagagggcaatgtctgattgaggtctgtgggaagagatgtttcattggatttatgaagcaccaacgaatgcttaagtcttctttctgaaaatgtgttgtaggcttcacttcttagagggtgaaaggtcctcggagataaaggagcatggtgtgtgtgcttctcttttttcttttttcgtgtcttaatgagaaactggcttttcttcagtctactctttcctccatcctgtcttacttgtagagatttatgtctaactctaggaaactttgggtggccactctgctttccaggcttgttggcaagaggggtgctttctccccaagcacgtgaggcattctgggggctgatcagccaattgttaacagctgtgtcttcatcagtatcttggattatttcatagctacctttctcagaagccaaatgccatctcccaaccaaaatcttagatgagttactttgttttaagagtaacagatcactaggagggtccttccagggcctcattctggaaggagaaccagtgtcttggctaggaaggtcctcccagggcctcattccggaaggagaaccagtgtcttggcttaggtgtctcccaactttatgtgctagtaatttcatccaggagaacctgtgctttgctgcttgatctctttctaccttgggtcccttatgcttagcatgttcttgacttttgaattctccagcaccaagtgaaagtagacgtatccctgtgacatctggctgtagaggatcctctatagggtcttcagaatatgggctggaatgctctgctgtggaagaattgagaactgagttcttgccaatgaggtgtctcagtggggaaccagctgtggtggcttgttggtgagaaggggctttctgaggttctgcaaggttattgacagtgaacttactaatattacttggggaagaataatttgaaccaacaattatatctgtgtttgaagaaacgaattcagtgccattctccagagctagggcagtaagattgaactcttcttcttcctgattcaatgatgagtttcggaatgacctgattcctaatgctgcagccagtctgttctggtaatcatagtcagcatcactctcttcatcttcaggttctaaacgatcatgcattttccgtgtagccatgactgtagattctggaggttcaaaaatctcatatgagtcttcatcatcatctgggatacatttaacatccctgaatttcagcctcagctttttgcttcttggactagaattcatggaagttaacatccaagttccaacattatccattgtgaccgtcacagattctccacgcatggggaagagggtcaaggtgtcctcatgcctctttccatagatgaatgagtgcccagtgaagtggatggtcaaaatttcattctgggtccccacactacagaagtgccactggacagtgtcatcaaagcagaatccaagagtagttatgctctcaggcacatagccattgatagtgctcatgatgtttgattcataaaacttggggtcatcacgtttcacctcatcaggattttcacaaaacttgttgatgttgtcctcaaggtaccagcttttgttctcatcaaacacagcaaacacagcctgctgttcgatgtctgctgccctctgtattcctcgcctgtccagggatctgctcttacagattagaagtagtcctattagcccagaggcgatgtctctcatgatgtccacgtcactgtagtatggtcttgttaagcactgggcatcattttctgtgggttcatcaaactctaagatgttccacttataagtataggtttcccctggttgaactgctctgatcatggtgttgttcctgcctgaggtgaaagaagagttgacttcatcttcataaggcgagaaggtcactccatgagggtaaatgctataggggcggctggccatatttttgaacacgattttgagtgtgtctctgacctgggctctgataataggacccaaaatcccatcttctttcatattgggattcactgtatgtttggtgaaggactcatcttcgtactgtgtgtacataactttcttataatgttttccaatttggtttgagaaattatccaaatgctgagacctgtattttttgtccatattcgctggtattacaggtgcatagtcccaaatgacttcctctgcagcaatgaagtattcccacctcttcatgtgccgcctctgctcacgagttattttcttaagattcctggttttctttgggcagtttttaatgtcaatgtaagcctgcatcccagcttgcaaatgttttggggtgagagaagatatgatccactttccctctgggcccacagtcatatttgcggtagtggatgtagcactgacaagggtgatggctgagaccttatgatggttctgctccaggacctggccgttgaaatgaatggagaataattctggccccgagctcattcccagcagatgccagctgatgtggtcatgggcacaaactgttatatctggcattgtcccattcacatatccattgactgtgtacattagggatgatgactggctccagctcttgctttcatcaaacacagcaaatagtagcacgatttgcttgtcaaacgtcttctgtgtcccaccctcagttagggtcccttttttacagataagcaggggcccaatcagccccgagttgaaatcctcgatcagattttcatgggagtaatagatgtgtgtgaggcatggagggtcatcatgggtgggtccactgtcctcactgatactccattcataggtgtattctcggcctggagccacagcgtcgtccatcttctccgcagggaatgtgtggtcaaggtaagaagcaccttctgataatttactgtacctaattccttgaggatggatgctcaagggcttatctgccttatttttaaagtgaacttttatgatgtctccgacttcagcatataaagtaggcccaagaagtcctgaaatggtagattgtggtttttctttcttaaaatatggttcatactctctgtagacaattttcttaaaggaagttacagaaagattcaaacttgagtttgtgggctcaggtcggtagctccaactgatgccctgagcagccacgtagaactgccttagctgtgccgcttctgtcccttggctcccccagcctacccagctggtgcccaagaccaccaggacccagaggcgtgggcagcctgggaacatgcttcctttcctgctcccgctggctgccaccaccccaggacctgggcagcgcttgccgagctgctaaccacactccgggctgtcccagctgcaatgagctctagaggctgtgggtggcagcgtcctcctcccctgcagttcttgc

SEQ ID NO: 6 - DNA, 7433 bp, Mus musculus
  source 1..7433: mol_type = genomic DNA
caagctttaaaaatcttttatttaccgttagtgcttgtacatggtcgtgggtcatgcagaaaccaggggacggctttctggaatatgctctctcctttcactgtgggttccaggacttgaactcaagccataaggtttgttttgtgttgtgttgctgttgttgttttgttttggcagcaagcacttttgcccactgagccagcccaacactgggtatttttaagttctcacttaattacaacaagatatatttttctctatgataaaaaaaaaacctcaactacttttgtttctattgtttacaaattacagtttgcttttaaaagaaaaatatagaaagaaaggctttctaggtccatgaaaaatttccaaaagtattatcttttgctaatgtctacaggatttcaaagagccacagtgaatcatatcattccattatataactattatattatacaatgtctttaatcagagtgaaaaacagtcatattcttgccaggtcttaatatttccccatttatattcaaatcagtgaagaaataatagctgccatctcacttagtggcagcgatgaaggagtattaaaagcttctcacataaagcttattctcaactagaaaaaaatagcagaacttctgttaacatttaaaatacccatgctatagggcctgctctaaatggtttaggcttgaaggagtttcttcagcttttattctctcttttcctttttttttctctttttggaatttaattctaataaatgtcacagccgaagagctctaggcgaagggcgatgctctggttccatgttttaggaatgatgcggataaatctggaaataatgggcgggttgaaaaagttcttcatgtgccccttggtattgctgtttccttcaaaaatcttgtccaccatggaggatttctgtcggtaaggtttccatgccacaccctggtcactgtactggatgctgtagctcttcacgtacatctcagaggacagagacttacagccctgcgttacgatggccgttaccttcttgattttgagcagatcgacttgtaaccactgcttgttgttgtttgccttggcttgccaggcgttcacgcggccctgggcgttcaggcgggcaagggagggctcccagtagtctccccaccacgactttttaaatgaagatgcagtaatttgcttgtcttgaatccgtccatcttccaggcccagtggtgtggaacatccgttcacctcacagccctgcagctccagccgaagggtgggtctattataggattttgttgggtgtatcctaatgtatctagccacaatgggtgggtcaagtcgattctcttttattgtagagccatctgaattaccagtaaaatacatcacgctcttcccgctcttccctctgaagatctgccagttggtttggtcagagctgtaagccacttggaactccgtggtaaagcaggactttaggtagtgtttagcaccttgggtttgtatcccggtgactacaacttccttctgcatgtccacctggatccaaggtttaatgggaaaatctaatgcagttttttctatactccaagcattgtatgaaccagcattgtttaatcgtgctaatctgggctcccaataagtcagatattccgaagccttgatctgtgaatcagatatgacaccagtgcttagtcccattggcatcttacactctttgtctatgatgagaaatggcgtttgcatgccagctacctggttttctccaacctctgtgtctaggagccaccagccaggcttggatgccttcatttcaagagttttaaatgaaccaggcagaaggggccagacgcctaactggtgctgtttggtcctattatccagcagggtctggccatggaagtgaaccacgtgaatatctcgggagccgcccatgttcagcaggtgtagcctcacccactcttgctcgtacattctcaggccgggcaggttgtagatcatcccattaattgcgtaaaacttgtgggcatttttctcttctggggattcaattctccgtgaccccttggacttttcatagtaccagctcttcttctcatcaaagaccatgaagagtaagacaaactctctcatgtccataggcaggttgcgctccatgtgaagtgttcctttccggcagatcagaagggggccgatcaagcctgagtggatgtccctctccacattcactgcagaatagtaggcccaagcccggcaggcagaaccagggttctctggccctgagcgcttggtggcatgccatacataggtgtaactgctattgggctggacagcatcatcttcctgaaaccattcaggagattcatcttcataagtcttcccctctgaggatttttcataggaaagtccgtgagcatgaagagaatacggtctggatgccaaatttttaaatcgaacttggatcacatcatccacttcagcccggatcacaggaccgagaatgccaaggtgctcctcatattctgcccgaggatcacgacttgtaaacgtgctatcaaggtattttctgaaaacgactttcttgtatgtggtgtcctttggagtgtggcctgtgtcttcatggtccatttcactttgtgcaaactctgcgtaattccaggttatttcttcagctgcaatatagtagaattttttgtgtccaccgtggcctcggaggtaccatgctgcgatagtgtcaggatttctggaggaattgacatctgtcctagtgtctgttctgtaggggtcattataggttacaaagtcatcctcggcataatcttcatctattctctctggctcctcacttggaacaatctcaacgtcgtctccatctactctactgagacctactacaacaagagggttaaatttccttgacaaagaagtgttattgagtgtgggagatggtgaaggaggtggtatgtgagtgagatctggatgaggaagagtccgattcagttctggaagcgatgaagcctgaccagaatctggagggtaggatgcttgatcagggtctgcagaggatgctttgtgtccatgattaagagcagggtttgtctggatgaggtctggagagagggtcacttgaccaaggtctggggctaggattatctcattaaaatctggtgagagggtcaagaggctgaggtctggggaaacggtcacctgactattgtctgaagggagtggcagctgatccaagtctggggaaaggactgtctgaccaaaatcaggagagagagtcagtaggtctgtggaggaggtctcctggttttggtctgaggagagaggtacctgactcaggtctaggaagtaattctggttgtcttcaggaaaaagaggcacctgacccagatctggggaagaggtcttctggttatcagaagaaaggggcacctgacccaggtctggggaggtgatcatctggttgtcatctggagaaaggggcacctgacccaggtctggggaggtcgtcttctggttgtcatctagagaaaggggcacctgacccaggtctggggaggaggtcttctggttatcatctggagaaagggacacctgacccaggtctggggaggaggtcttctggttgtcatctggagaaaggggcacctggcccaggtctggggaggaggtcttctgattgtcttctggagaaaggagcaactgatccaggtctgggtaaataattgtctgatccaattctggagagatggtaaagaggcttaagtctgaggaagggattgcttggtcatcatctgaagagaaagatgacttttgactttggtctggaaagaaagatgttagaccaatgtcatcagggtaaaagtcatgacttaggtcataatcaagcccctggctgagctctggcggagaggatctgtagctaggatctgtggtagagtgtgtttgatcaggatcttgggcaggaaatgttggagagtgttcctctgcgggcactgactgataaagatctaaagaagagctcatctgctcagtgtcatttttcgagtactgattatagtcaggaagtgacctgtccgtactcattgaaggagaggtctggttcaggtctggagaaagagctgtttcattggacttgtggagtaacagtgagtgattaagtagtctcctgtctggaaatggggaatggttatgtcctctcaaagggtcaaagccccttggagatagaggactgtgtagtgcaagcttcttatttttcttcttcttccgtgtcctgatgaataactgtcttttctgaaaaccactgttttcttcctcctgtcttacatgtggagatttatgtccaactccagaaaatgttgggaggtcacttggctttcttgttgtgtttgtgtgagaggtgctctctccccgaggtactgtgatattctgattttgaggactgttggtcagcttatccacatctgtgtcttcaccatttgctgctattatttcataactacccttttcagaagccacacgccatcgtctattcagaaatttggaagtgatcttttgctttaagggtatcaactcgctaggaatgtcctcctcagacttcattccagaatacgaattctttgggtttgaatgcctcccagttttaccagctggcgctttcatccaggagaacctgtgcttcatcatgtggggtcttcctgtcttgatggttttaggtttatcttgttctcgattcccagatccttttggaccaagaggaagtaggtataccattgtgatgtttgactgtggattttccatatcattttcatgatatgagctggaacgatgttctgtagaagagttgaggacgaagttctcatctaagccaatgaggtttctaaggagggtaccagccacggtggctcctgagccaggaagtgttctttgaaagtctttgaggttattattgatgattttactaaggattcgtgaagagtttgagtcaacaactctgtctgtgcttggagatatgaactcagagctgttctccagagcgagagcagtgagattgaactcattttcctctggattcaatgatgagtttttgaatgacctaattcctaatgatgacgccagtaagtactggtaatcatcatcttcgttgtctatgccaaattcattttctaaggaatcatgaattctccgagttgtcatggatgtaggtgcaggaggttcataaatctcatatgagtcctcattgtcataatcccgattacacttaacatctctgaatctcagtcttaggtttctgcgttttggattggaattcatggtggtcaacatccaagttccaacattatccattgtaactgtcacagattcaccacgcatggggaacagggtcaaggtgtcctcgtgcctcctcccatagatgaacgagtgcccagtgaagtggatggtcaaaatatcatcatgagttcccacactgcagaagtgccactggacagtgtcatcaaaacagaatcccagagtggaaatgctctcgggcacgtagccgttgatagtgctcatgatgtttgattcgtaaaacttgggatcatcacgcttcacctcatcaggattctcacagaacttgttgatgttgtcctcaatgtaccagctcttgttctcgtcaaacacagcaaacacggcctgctgctcgatgtctgccaccctctgtacacccctctggtccagggacctgctcttacaaattagaagcagccctatcagcccagaggcaatatcccttgtaacgtccacatcactgtagtatggccttgttaggcactgggcatcgttttccgtgggttcatcaaactctagaatgttccatttgtaagtgaaggtttcccccggttgaactggtctgatcgtggtgtgactgcctgaggtggaggaagaattgattccatcttcgtaaggagagaaggtcaccccgtgagggtaaatgctgtagggtcggctcgccatatttttgaacacgatcttgagtgtgtctctgacctgggctctgataacagggcccagaatcccactttgtttgatgctggggttgtcagtgcgtttggtgaaggtctcttcttcatattgcctgtagataactttcttgtaatgttttccaatttggtttgagaaattatccaagtgctgagacctgtaaattttgtccatattcgcaggtatcacgggtgcatagttccaaatgacctcctctgcggctatgaaatactcccatctcttcatgtaccgcctctgctcccgagtgagggtcttggggctcctcgttttctttgggcagtttttaatgtcaatgtaagcctgcatcccagcttgataatgctttgggatgagagaagaaacaatccatcttccttctgggctcatagtcatgtttgcagtcgtagatgttgcgctgaccagggtgacggtggacactttatgctggttctgctctaggacttggccgttgaagtgaatagaaaacaattctggccccgagctcatcccgatcagatgccagctgacgtggtcatgggcacagactgttatatctggcatcgtcttattcacaaagccattaattgtgtacattagggatggtgactggctccggctcttgctttcatcaaacacagcaaataggagcacatgctgcttgtcaaacatcttctgagtcccatcctcggtcagggtgcctttcttgcagataagcagaggcccaatcagacccgagttgaaatcctgggtcaggttttcataggaatagtagatgtgggtgaggcatggtgggtcatcaggtgtgggcccgctgtcctcactgacgatccattcataggtgtattcttctccaggagccacggcatcatccttcctctcggcagggaacgtgtggtctgcgtaagaagccccttctgaaaatttactgtatttaatcccttgaggatggatgcttagtggtttgtctgctttgtttctaaagtgaactttaatgacgtccccaacttcagcgtataaagtaggtccaagaagtcctgagttgctagatcgtggcttttctttcttaaaatactgttcatactctctgtagacaattttcttgaaggaaggtatagaattcaaacttggatctgtgggctcaggatgatagttccagaggatcccctgagctgccacatagaactgccttagttgcgcggcctctgcctggtggctgccccagcccgcccagcgggttcccagaaccaccaggaggaagaagcacgggcagactaggagcatggcccttgtcctgccgcgcgctgccaccaccgacagtgctcagtgctctgtccctgttgcgcgctgatctgtctccctggaggactaagaagctgcagggcacagtgagtgtccctgtcccctgtggt

SEQ ID NO: 7 - DNA, 6315 bp, Rattus norvegicus
  source 1..6315: mol_type = genomic DNA
tttattctaataaatgtcacagccgaagagttccaggcgaagtgcaatactttggttccatgttttaggaatgattcggataaatctggaaataataggtgggttgaaaaagttcttcatatgccctttggtattgctattcccttcaaaaatcttgtccaccatggaggatttctgccggtagggtttccaggagacaccctggtcactgtacaggatgctgtagctcttcacatacatctcagaggacagagacttgcaaccctgagttacgatggccgttaccttcttgattttgagcagatcaatttgtaaccactgcttgttgttgtttgccttggcttgccaggcattcactcggccctgggcattcaggcgggcaagggaaggctcccagtagcttccccaccatgactttttaaatgaagatgcagtaatttgcttgttttgtatccttccatcttccaggcccagtggtgtggagcatccgttcacctcacagcccaacagctccaaccgaagggtgggtctgttataggatttcgtgggatgtatcctaatgtatctagccacaataggtgggtcaaatcgattctcttttatcgtagaggcatctgaattgccagcaaaagaataaagtaccaagagaaacagactcaaggtggtttgcacaatgatgacagacaggctctctgcatttgaatatttttctttggggaggagcctgggaatgaggaatgatctaggaatcttgtctgggctcatggagtaccagacagggtctgtcagtcctctagcatgtcctccaaggcagctcagatattctgaagccttgatctgtgagtcagatatggcaccagtacttagacccattggcatcttgcactcaggcaagaggggccagacccctaagtggtgctgtttggtcctattatccagcaggatctggccatggaagtgaaccacgtgaatatcttgggggccgcccatgttcagcaggtacagcctcacccactcttgctcatacattctcaggccgggcaggttgtaaatcatcccattaattgcgtaaaactcgtgcgaatttttcgcttctggagattcaattctccatgaccctttggacttttcatagtaccagctcttcttctcatcaaagaccatgaagagcaagacaaactctctcatgtccagaggcaggttgctcgccctgtcaagtgttcctttccggcagatcagaagggggccgatcaagcctgagtggatgtctcgctccacatccactgcagaatagtagacccaagcccggcaggcagaaccggggttctctggtcccgcgcgctcagtggcatgccatacatatgtgtaactgctattgggctggacagcatcatcttcctgaaaccatttaggagagtcatcttcgtaattctttccctctgaggacttttcataggaaagtccatgggcatgaagagaatatggtctggatgctaaatttttaaatcgaacttggatcacatcatccacttcagcacgtattacagggccaagaatgccaaggtgctcctcatattccccctgaggatcacggcttgtgaaagtactatcaaggtattttctgaaaacaactttcttgtatgtggtgtcctttggagtgttgtctgtttcttcattgtccatttcacttggtgcaaattttgaataatcccaggatatttcttcagcagcaatatagtagaattttttgttcccaccgaagctacggagataccatgctgcaatagtgtcagggtttctggaggagttgacatttgccctggtgtctgttttgtaggggtcattgtaggttacatagtcatcctcaggataatcttcgtcaatgctctctagctcctcacttggaatcatctcaacatcgtctccatcaactctactgagacctactacaacaagggggttaaatgtctttgacaaagaagtgtcattaggtgtgggagatagtaaaggaggctgcatgtgaatgaggtctggatgaggaagagtctgattcagttctggaagaggtgaagactgaccagaatctggggggtaggatgcttgaccagggtctgcagaggatgttttgtgcctgtgattaagagcagggcttgtctggatgaggtctggagagagggtcacctgatcaatgtctggggatagtattatctcattaaaatctggtgagagggtcaagaggctgaggtctggggaaagggtaacttgactgttgtctgaagagaggggcatcttatccaagtctggggaaatgactgtctgaccaaatttcggagagagagtcagtaggctaaggtcagtggaggaggtctcccagctttggtctgaggagatgggtacctgacctgggtctaggaagtaagtcttctgcttgtcatctagagaaaggagcacctgacctaggtctggggaagtcttctggttgtcatctggggtaaggggcacctgacccaggtctggggaggaggtctcttggttttcatctggagaaagggtcacctgacccaggtcttgggaggaggtctcctggatgtcatctggagaaagggtcacctgacccaggtcttgggaggaggtctcttggttttcatttggagaaagggtcacctgacccaggtcttgggaggaggtctcttggttttcatctggagaaagggtcacctgacccaggtcttgggaggaggtcttctggatgtcatctggagaaaggaacaactgatccaggtctgggtaaataattgtttgatccaattctggagagatggtaaagagatttaagtctgaggaagggattgcttggccatcatctgaagtgagaggtgacttttgactttggtctggaaagaaagatgtttgactaatgtcatcagaataaaattcatggcttaggtcataatcgatcccttgactgggctctggaggagaggatctgtagctaggatctgtggtagagtgtgtttgattaggatcttgggtaggaaatgttggagagtgttcctctggtggcactgactgaaaaaggtctaaagaagagctcatctgctcagtatcatttgaagggttctgattatagtcaggaagtgacctgtcagtactcactggaggggaggtctgattcagatctgtggaaagagctgtttcattggatttgtggagtagtaatgaatgattgagtagtcttttcctgttcttcttcttcttccgtgtcctgatgaacaactgtcttttcttaaagtcaccgctttcctcctcctgtcttacatgtggagatttatgcctaaatctagaaaatgttgggaggttacttggcttccctgtcgtgtttatgcgagaggtgctagctccccaaggcgttgagatattctgattttgaggactgtttgtcagcttatcaatatctgtgttttcaccatttgctggtattatttcataactacccttttcagaagccatatgccactgtctgttcaaaagtttggatgcgaccttttgttttaagagtaacaaatcactaggaatgtcctcctcagacttcattctggaagaagtattctttggatttgaatgcctcccagtttttccggctggagctttcatccaggagaacctgtgcttcatcctgtggggtcttcctgtcttgattgttttaggtttagtctgttctcgactccctgatccttttgcaccaagaggaagtaggtataccactgtgatgttcgactgtgggtcttccatatcattttcataatatgagctggaatgatattctgttgaagggttgaggacggagttcttacctaagccagtaaggtttccaagtaggataccagctatggtggctcctgagccagaaagtgttctttgagagtcgttgaggttattattggtgatcttactaaggtttcttgaggattttgagtcaacaactccgtctgtgcttagagatatgaattcagagctgttttctagagcgagagcagtgagattgaactcgtcttccttcggattcaacaatgactttctgaatgacctaattcctagtgttgacgccagttcgtactggtaatcatcatcttcgttttctatgccaaagtcattttccacagaatcatgaattttccgagttgtcatggatgtaggttcaagaggttgataaatctcatatgagtcttcatcgtcatcatcattccggttacacttaacatccctgaatctcaatcttaggtttctgcgtcttggattggaactcatggtggtcaacatccaagttccaatattatccatcacgacagtcacagattcaccactcatggggaacagggtcaaggtgtcctcgtgcctcctcccatagatgaatgagtgcccagtgaagtggacggtcagaatgtcatcatgagttcccacactgcagaagtgccactgtacggcatcatcaaaacagaatcctagggtggatatgctctcaggcacgtacccattgatagtgttcatgatgtttgattcataaaacttggggtcatcacgcttcacctcatcgggattctcacaaaacttgttgatgttgtcctcgatgtaccagctcttgttctcatcaaacatagcaaacacgacctcctgctccatgtctgctacccttagaaatggcatatggcgaactactagagcttccgattttctggcaccttcccttagatacaagaacacaagaatagcacctagcttgtagaactgatgtgacagccttagcaaacacctactacaagggttaacagtagctagcattctactgccattgttcctgttactatcatcaggccacattcccatgggacttagtggataagaatgcttgtccatgtttgcgggtatcacaggtgcgtagttccaaatgacttcctctgcggcgatgaagtactcccacctcttcatgtgccgccgctgctctcgggtgagcgtcttggagctcctggttttctttgggcagtttttaatgtcaatataagcctgcatcccagcagctctggttgcccaagggacaaggagatcctcaccacgggatgctatgtaaccttgcacagtatttaaagctattggtcggataaagatgcctacagtctgcagcagagtcacggtggacactttatgttggttctgctctaggacttggccgttgaagtgaatagaaaacaattctggtcccgagctcatcccaatcagatgccagctgacatgatcgtaggcacagactgttacatctggcattgtcctattcacaaagccgttgactgtgtacatgagggctggtgactggctccagctcttgctttcatcaaatacagcaaacagaagcacgtgttgcttgtcaaacatcttctgagtcccatcctcagtcagggtgccttccttgcagatgagcagaggcccaatcaggcctgagttgaaatcctgggtcaggttttcataggagtagtagatgtgggtgaggcatggtgggtcatcaggtgtgggcccgctgtcctcaccgatgaaccattcataggtgtattcctctccagcagccacagcatcgtccttcctctcagccggggatgtgtggtccaggtaagaagcccctggagaagtgaccgccacaaagacatccagagttttccaccactcgccagtgtggagaaagggtgatgcgctagctctttctggctcttccccacccctgcggtctccacatccagctcctgcatgcagcctactccttgggcacatgaagccagtctgtcccagggtgaagatgcctcgcttcattgtgtaaagacccattgacaacctatgaacaccgggcactccctccaggagtagaggggtgacgtagaaaccagtcttccgttttggaagaagaaccaatgcttgctgactgagtgagggagggtcaaataaacatcgaaggaggatgaatggtgctgcaaagtccatttcctcctccgcaaacagctgagcttctgaaaatttgctgtatctaattccttgagggtggatgcttagaggtttgtctgctttgtttctaaagtgaaccttgatggtgtcgccaacttcagcatataaagttggtccgagaagtcctaaggaaggataggtttgaaattgtttatattcaagatcatgaaagacatatagaggaacatatagaaaggccccgacatgatttttgtcactcctccggatctccgcctgcttctcttggacttgaccttctgagctttgcat

SEQ ID NO: 8 - DNA, 6936 bp, Macaca fascicularis
  source 1..6936: mol_type = genomic DNA
taaaaccttcttgtataaaattttattcactaatagaaaaaaagagaaatagtggaaaactgttaacatttaacacagtgtaaatacattgcccattctaaatggtttgaggtcttaaagaccctcttccaggggtttttgaatattcagttctagtaaacatcacagccaaagagttccaggcgaagtgcaatactttgattccatgttttaggaatgacacggataaacctggaaatgattggggggttgaaaaagttcttcacatgtcctttggtattagtatttccttcaaaaatcttgtccaccatggaggatttcagcctgtacggtttccattccactccctggtcactgtagtggatggtatagctctttacatacatttcagaggacagagacttgcagccctgtgttgtaattgctgttatcttcttgatcttgagtagatcaatttctagccactgcttgttgttgtttgccttggcttgccaggcattcacacgtccctgggcattcagacgggcacggaagggttcccagtaatctccccaccaagattttttaaacgaagaagctgtgatttgcttgtttcctatctttccattttccatacccagcggtgtggaacatccatttacctcacaaccttgcaactccaatcgaagggtaggtctgttataggctcgggttggagagatcctaatatatctagccacaataggtgggtcaaactgattctcttttattgtagaggcatctgaattgccattaaaatacatcacattccttgtgctgttccctttgaagatctgccagttgatctggttggaactgtaagctacatagaactctgtggtatagcaggacttcaggtagtgtttggcaccttgggtctggatccctgtgattacgacttccttttgcatgtccacctggatccaaggtttagaggccaattctgctgcaagtttttctacactccaagcattataagatccaccattgtttagtcttgctaatctgggctcccagtaacccagaaattctgaagccttgatctgtgaatcagatatgataccagtgcttagtcccattggcatcttacagtctctgtccatgataagaaatggcgtttgcatccctgctctctggttttctccaacctctgtgtttaggagccaccagccaggttttgatgccttcatttcaagagttttaaatgaaccaggcagaagggcccagacccctaactggtgctgtttattgccattttccagcaaggtctggccatgaaagtgaaccacgtgaatgtcttgggagccgcctatgttcagcaggtgtaacctcacccactcttgctcgtacattctcaggccaggcaagctgtagatcatcccattaatggcgtgaaactcatgggattttttcacttctgaggatgtgagtctccaagaacttcgggacttcttttcatagtaccagctcttcttttcatcgaaggtcataaatagtaagacaaattctctcatgtccacaggcatgttgctgtccttatgtagtattcctttttggcagattaggaggggacctatcaagcctgagtgaatatctttttctgggttcacagctgagtagtaggcccaagcccgacaggcagagccaggactttctggccctgatcgttcagtggcatgccatacgtaggtataactgctatttggctgaacagcattgtcttccttaaaccattcaggagagtcatcttcataagtctttccctctgatgatttttcataggaaagtccatgggcatgtagagaatatggtctggatgctaaatttttaaaacgaacttggataacatcatccacttcagctctgataataggaccaagaattccgagatgctcttcatactcccctcgaggatcacgtttggtaaaagtgctgtcgaggtactttcgaaaaactactttcttatatacggtgtcttctggaatatcatcagagtcttcaatatctgtttccctgtgtacaaattctgaataatcccaggatatttcttcagcagcaatgtaataatttcttctgtttccgttgttgctgcggaggaggtaccatgctgcaatgttgtcaggatttctggaggagttgatgtttgtcctaacatcagttttgtaggggtcatcatagggcacataatcaatttcagcatagtcatcttcactgctctggacctcttcctttggaataatctcaatgtaatctgtaccatctttactgaggcccactataaccagtggattaaattcctttgatagaaaagtatcattgagagtaggagatgaaggagatggcatctgaccaaggtctggataaggaaaagtctcattaaattctggaagatgcaataactgactagattcagaagggtagaatgtctgatcaaggtctggaggaggtgatatctggctgagatcagggagaagggtggtctcactgatgtctggagagacagtcacctggctgaggtctggagaaaggggcatctgaccgagggctggggaaaggtttgtatgactgagttctggagagaggtttgtctggctgaggtctggagaaagggttgtatgactgaggtctggagagaggtttgtatgactgaggtctggagaaagggttgtatgactgaggtctggagacatgggcatctgaccgagggctggggaaaggtttgtctgactgaggtctggagaaagggttgtatgactgaggtctggagagaggtttgtatgactgaggtctggagaaagggttgtaggactgaggtctggagaaaggattgtatgactgagatctggagaaagggttgtaggactgaggtctggagaaagggttgtgtgactgaggtctggagaaagggttgtatgactgaggtctggagaaagggttgtaggactgaggtctggagaaagggttgtatggctgaggtctggagaaagggttgtatgactgaggtctggagaaagggttgtatggctgaggtctggagacatgggcatctgaccgagggctggggaaaggtttgtctgactgagttctggagagagagtcgtgtggctgaggtctggcgagaagtttgtttggctgagttgtggagagagggtcacctggctgaggtctgcagaggggactgtctgccagacttcacgttctgaggaaggggacatttgacttatatcagtggggaaggacttgtgacttcggtcatactcaagcatctccctgagctctggagcagaggatctgtgactggggtctgaagtagagtgcatttcatcagggtcttgaatggggaatgtttcatagtgttcctctgggggcactgtctgataaagatctggaggagagcttgtctgacgagtatcattcgaggaattctgattatggtcaggaagtgaggctatccagctaaaatccatagagggcaatgtctgattgaggtctttgggaagagatgtttcattggatttatgaagcaacaatgaatggttaagtcttctttctgaaaatgtgttgtaggcttcagttcttagagggtgaaaggtccttggagataaaggagcatggtgtgtacgcttctcttttttcttttttcgtgtcttaatgagaaactgacttttctttagtccactctttcctccatcctgtcttacttgcagagatttatgtctaactctaggaaacctcgggtggccactctgctttccaggcttgttggcaagaggggtgctttctccccaagcacgtgaggcattctgggggctgatcagtcgattgttaacagctgtgtcttcatcagtatcttggattatttcatagctacctttctcagaagccaaatgccatctcccaaccaaaatcttagatgagttattttgttttaagagtaacagatcactaggaaggtcctcccagggcctcactctggagggagaaccagtgtctcggcttaggtgtctcccaactttatgtgctagtaatttcatccgggagaacctgtgctttgctgcttggtctctttctaccttgggtcccttacgtttagcatgttcttgatttttgaattctctagcaccaagtgaaagtagatgtatccctgtgacatctggctgtagaggatcctctatagggtcttcagaataagggctggaatgctctgctgtggaagaattgagaactgagttcttgccagtgaggtgtctcagtggggaaccagctgtggtggcttgtcggtgagaaggggttttctgaggttctgcaaaattattgacagtgagcttactaatattatttggggaagaataatttgaaccaacaattatatctgtgttcgaagaaatgaattcagtgccattctccagaactagggcagtaagattgtactcttcttcttcctgattcaatgatgagtttctgaatgacctaattcctaatgctgcagccagtctgctctggtaatcatagtcagtgtcactctcttcatcttcagtttctaaaggatcatgcattttccgtgtagctatgactgtagattctggaggttcaaaaatctcatatgagtcttcatcatcatctgtaatgcatttaacatccctgaatttcagcctcagctttttgcttcttggactagaattcatggaagttaacatccaagttccaacattatccattgtgaccgtcacagattctcctcgcatggggaagagggtcaaggtgtcctcatgcctctttccatagatgaatgagtgcccagtgaagtggatggtcaaaatttcattctgggtccccacactacagaagtgccactggacagtgtcatcaaagcagaatccgagagtagttatgctctcgggcacatagccattgatagtgctcatgatgtttgattcataaaacttggggtcatcacgtttcacctcatcaggattttcacaaaacttgttgatgttgtcctcaaggtaccaacttttgttctcatcaaacacagcaaacacagcctgctgttcgatgtctgctgccctctgtattcctcgcctgtccagggatctgctcttacagattaaaagtagtcctattagcccagaggcgatgtctctcatgatgtccacgtcactgtagtatggtcttgttaagcactgggcatcgttttctgtgggttcatcgaactctaagatgttccacttataagtataggtttcccctggttgaactgctctgatcatggtgttgttcctgcctgaggtgaaagtagagttgacttcatcttcataaggtgagaaggtcactccatgagggtaaatgctataggggcggctggccatatttttgaacacgattttgagtgtgtctctgacctgggctctgataataggacccaaaatcccatcttctttcatattgggattcactgtacgtttggtgaaggactcatcttcgtactgtgtgtacataactttcttataaagttttccaatttggtttgagaaattatccaaatgctgagacctgtattttttgtccatattcgctggtattacaggtgcatagtcccaaatgacttcctctgcagcaatgaagtattcccaccttttcatgtgccgcctctgctcacgagttattttcttaggattcctggttttctttgggcagtttttaatgtcaatgtaagcctgcatcccagcttgcaaatgttttggggtgagagaagatatgatccactttccctctgggcccacggtcatatttgcggtagtggatgtagcactgacaagggtgatggctgagaccttatgatggttctgctccaggacctggccattgaaatgaatggagaacaattctggccccgagctcattcccagcagatgccagctgatgtggtcatgggcacaaactgttatatctggcattgtcccattcacgtatccattgactgtgtacattagggatgatgactggctccagctcttgctttcatcaaacacagcaaacagtagcacgatttgcttgtcaaacgtcttctgtttcccatcctcagttaggatcccttttttacagataagcaggggcccaatcagtccagagttgaaatcctcgattagattttcatgggagtaatagatgtgtgtgaggcatggagggtcatcatgggtgggcccgctgtcctcactgatactccattcataggtgtattctcggcctggagccacagcatcatccatcttctccacagggaatgtgtggtcaaggtaagaagcaccttctgataatttactgtacctaattccttgaggatggatgcttaagggcttatctgccttattcttaaagtgaacttttatggtgtctccgacttcagcatataaagtaggcccaagaagtcctgaaatgctagattgtggtttttctttcttaaaatatggttcatactctctgtagacaattttcttaaaggaagttgcagaaagattcaaacttgagtttgtggactcaggtcggtagctccaactgatgccctgagcagccacgtagaactgccttagctgtaccgcttctgtcccttgtctcccccagcctacccagctggtgcccaagaccaccaggacccagaggcgtgggcagcgtgggaacatgcttcctttcctgctcccgctggctgccaccaccccaggacctgggcagccgctcgtcgagctgctgactaaccccgctcctggctgtcccagctgcaatgagctctgaaggctgtgggtggcagcgtccttctcccctgcggttcttgcaaactgcagcggcagcctctgcctctccctccctcccctttttctggggcttttcctggcaggggcttggtgagatcacagctcccag

SEQ ID NO: 9 - RNA, 21 nt, synthetic construct
  source 1..21: mol_type = other RNA
caggcttacattgacattaaa

SEQ ID NO: 10 - RNA, 23 nt, synthetic construct
  source 1..23: mol_type = other RNA
tttaatgtcaatgtaagcctgca

SEQ ID NO: 11 - RNA, 21 nt, synthetic construct
  source 1..21: mol_type = other RNA
gcctcacacacatctattact

SEQ ID NO: 12 - RNA, 23 nt, synthetic construct
  source 1..23: mol_type = other RNA
  modified_base 12: mod_base = OTHER; note = 5'-methyluridine-3'-phosphate
agtaatagatgtgtgtgaggcat

SEQ ID NO: 13 - RNA, 21 nt, synthetic construct
  source 1..21: mol_type = other RNA
ctcacacacatctattactct

SEQ ID NO: 14 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
agagtaatagatgtgtgtgaggc

SEQ ID NO: 15 - RNA, 21 nt, synthetic construct
  source 1..21: mol_type = other RNA
agtatgaaccatattttaagt

SEQ ID NO: 16 - RNA, 23 nt, synthetic construct
  source 1..23: mol_type = other RNA
acttaaaatatggttcatactct

SEQ ID NO: 17 - RNA, 21 nt, synthetic construct
  source 1..21: mol_type = other RNA
tgcaaacgccatttcttatct

SEQ ID NO: 18 - RNA, 23 nt, synthetic construct
  source 1..23: mol_type = other RNA
agataagaaatggcgtttgcatc

SEQ ID NO: 19 - RNA, 21 nt, synthetic construct
  source 1..21: mol_type = other RNA
ctgctataccacagagttctt

SEQ ID NO: 20 - RNA, 23 nt, synthetic construct
  source 1..23: mol_type = other RNA
  modified_base 7: mod_base = OTHER; note = 5'-methyluridine-3'-phosphate
aagaactctgtggtatagcagga

SEQ ID NO: 21 - RNA, 21 nt, synthetic construct
  source 1..21: mol_type = other RNA
acagttttccactatttctct

SEQ ID NO: 22 - RNA, 23 nt, synthetic construct
  source 1..23: mol_type = other RNA
agagaaatagtggaaaactgtta

SEQ ID NO: 23 - RNA, 21 nt, synthetic construct
  source 1..21: mol_type = other RNA
caggcttacattgatattaat

SEQ ID NO: 24 - RNA, 23 nt, synthetic construct
  source 1..23: mol_type = other RNA
attaatatcaatgtaagcctgcg

SEQ ID NO: 25 - protein, 16 aa, unidentified
  REGION 1..16: note = source = /note="Description of Unknown: RFGF peptide sequence"
AAVALLPAVLLALLAP

SEQ ID NO: 26 - protein, 11 aa, unidentified
  REGION 1..11: note = source = /note="Description of Unknown: RFGF analogue peptide sequence"
AALLPVLLAAP

SEQ ID NO: 27 - protein, 13 aa, Human immunodeficiency virus
GRKKRRQRRRPPQ

SEQ ID NO: 28 - protein, 16 aa, Drosophila sp.
RQIKIWFQNRRMKWKK

SEQ ID NO: 29 - DNA, 21 bp, synthetic construct
  source 1..21: mol_type = other DNA
  modified_base 1: mod_base = OTHER; note = 2'-O-methylcytidine-3'-phosphate
  modified_base 2: mod_base = OTHER; note = 2'-O-methyluridine-3'-phosphate
  modified_base 3: mod_base = OTHER; note = 2'-O-methyluridine-3'-phosphate
  modified_base 4: mod_base = OTHER; note = adenosine-3'-phosphate
  modified_base 5: mod_base = OTHER; note = 2'-O-methylcytidine-3'-phosphate
  modified_base 6: mod_base = OTHER; note = guanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = 2'-O-methyluridine-3'-phosphate
  modified_base 13: mod_base = OTHER; note = adenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = guanosine-3'-phosphate
  modified_base 19: mod_base = OTHER; note = adenosine-3'-phosphate
  modified_base 20: mod_base = OTHER; note = 2'-deoxythymidine-3'-phosphorothioate
  misc_feature 1..19: note = RNA
  misc_feature 20..21: note = DNA
cttacgctgagtacttcgatt

SEQ ID NO: 30 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = 2'-O-methyluridine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = 2'-O-methylcytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = 2'-O-methyluridine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = guanosine-3'-phosphate
  modified_base 20: mod_base = OTHER; note = 2'-deoxythymidine-3'-phosphorothioate
  misc_feature 1..19: note = RNA
  misc_feature 20..21: note = DNA
tcgaagtactcagcgtaagtt

SEQ ID NO: 31 - RNA, 21 nt, synthetic construct
  source 1..21: mol_type = other RNA
aaagtggatcatatcttctct

SEQ ID NO: 32 - RNA, 21 nt, synthetic construct
  source 1..21: mol_type = other RNA
tcaaaccaaattggaaaacat

SEQ ID NO: 33 - RNA, 21 nt, synthetic construct
  source 1..21: mol_type = other RNA
taagtggaacatcttagagtt

SEQ ID NO: 34 - RNA, 21 nt, synthetic construct
  source 1..21: mol_type = other RNA
gaggacaacatcaacaagttt

SEQ ID NO: 35 - RNA, 21 nt, synthetic construct
  source 1..21: mol_type = other RNA
gcataactactcttggattct

SEQ ID NO: 36 - RNA, 21 nt, synthetic construct
  source 1..21: mol_type = other RNA
ttggaacttggatgttaactt

SEQ ID NO: 37 - RNA, 21 nt, synthetic construct
  source 1..21: mol_type = other RNA
gaagaagagttcaatcttact

SEQ ID NO: 38 - RNA, 21 nt, synthetic construct
  source 1..21: mol_type = other RNA
tcaaacacagatataattgtt

SEQ ID NO: 39 - RNA, 21 nt, synthetic construct
  source 1..21: mol_type = other RNA
aagtaactcatctaagatttt

SEQ ID NO: 40 - RNA, 21 nt, synthetic construct
  source 1..21: mol_type = other RNA
tatgaaataatccaagatact

SEQ ID NO: 41 - RNA, 21 nt, synthetic construct
  source 1..21: mol_type = other RNA
actgaagaaaagccagtttct

SEQ ID NO: 42 - RNA, 21 nt, synthetic construct
  source 1..21: mol_type = other RNA
tcattgcttcttcaagaattt

SEQ ID NO: 43 - RNA, 21 nt, synthetic construct
  source 1..21: mol_type = other RNA
tactctcaatgatacttttct

SEQ ID NO: 44 - RNA, 21 nt, synthetic construct
  source 1..21: mol_type = other RNA
aaacagaagaaattattacat

SEQ ID NO: 45 - RNA, 21 nt, synthetic construct
  source 1..21: mol_type = other RNA
agcacttttaccaaacgtgat

SEQ ID NO: 46 - RNA, 21 nt, synthetic construct
  source 1..21: mol_type = other RNA
gagagaatttgtcttactatt

SEQ ID NO: 47 - RNA, 21 nt, synthetic construct
  source 1..21: mol_type = other RNA
gacattcacgtggttcacttt

SEQ ID NO: 48 - RNA, 21 nt, synthetic construct
  source 1..21: mol_type = other RNA
ctgtgttaaatgttaacagtt

SEQ ID NO: 49 - RNA, 21 nt, synthetic construct
  source 1..21: mol_type = other RNA
ctttcttttctattagtgaat

SEQ ID NO: 50 - RNA, 21 nt, synthetic construct
  source 1..21: mol_type = other RNA
tttcacaaacacatgattttt

SEQ ID NO: 51 - RNA, 21 nt, synthetic construct
  source 1..21: mol_type = other RNA
tacttaaaatatcctgtcttt

SEQ ID NO: 52 - RNA, 21 nt, synthetic construct
  source 1..21: mol_type = other RNA
tttcccatataacaatgattt

SEQ ID NO: 53 - RNA, 21 nt, synthetic construct
  source 1..21: mol_type = other RNA
gtgtacatatatcaaaatgtt

SEQ ID NO: 54 - RNA, 21 nt, synthetic construct
  source 1..21: mol_type = other RNA
caacgaaattcataacaatct

SEQ ID NO: 55 - RNA, 21 nt, synthetic construct
  source 1..21: mol_type = other RNA
gaaactaccagagttacctgt

SEQ ID NO: 56 - RNA, 21 nt, synthetic construct
  source 1..21: mol_type = other RNA
ctttcttttcatgattcatgt

SEQ ID NO: 57 - RNA, 21 nt, synthetic construct
  source 1..21: mol_type = other RNA
cgcatgctaaatttaatgctt

SEQ ID NO: 58 - RNA, 21 nt, synthetic construct
  source 1..21: mol_type = other RNA
cctcttgaaatcctttatttt

SEQ ID NO: 59 - RNA, 21 nt, synthetic construct
  source 1..21: mol_type = other RNA
tctcttgatctagaatttact

SEQ ID NO: 60 - RNA, 21 nt, synthetic construct
  source 1..21: mol_type = other RNA
ccacaaactcaagtttgaatt

SEQ ID NO: 61 - RNA, 21 nt, synthetic construct
  source 1..21: mol_type = other RNA
atctttctgtaacttcctttt

SEQ ID NO: 62 - RNA, 21 nt, synthetic construct
  source 1..21: mol_type = other RNA
ctaccatttcaggacttcttt

SEQ ID NO: 63 - RNA, 21 nt, synthetic construct
  source 1..21: mol_type = other RNA
catcataaaagttcactttat

SEQ ID NO: 64 - RNA, 21 nt, synthetic construct
  source 1..21: mol_type = other RNA
tcaaggaattaggtacagtat

SEQ ID NO: 65 - RNA, 21 nt, synthetic construct
  source 1..21: mol_type = other RNA
tcttaccttgaccacacattt

SEQ ID NO: 66 - RNA, 21 nt, synthetic construct
  source 1..21: mol_type = other RNA
tcacacacatctattactcct

SEQ ID NO: 67 - RNA, 21 nt, synthetic construct
  source 1..21: mol_type = other RNA
tctgatcgaggatttcaactt

SEQ ID NO: 68 - RNA, 21 nt, synthetic construct
  source 1..21: mol_type = other RNA
gacaagcaaatcgtgctactt

SEQ ID NO: 69 - RNA, 21 nt, synthetic construct
  source 1..21: mol_type = other RNA
ccctaatgtacacagtcaatt

SEQ ID NO: 70 - RNA, 21 nt, synthetic construct
  source 1..21: mol_type = other RNA
attattctccattcatttcat

SEQ ID NO: 71 - RNA, 21 nt, synthetic construct
  source 1..21: mol_type = other RNA
caggcttacattgacattaat

SEQ ID NO: 72 - RNA, 21 nt, synthetic construct
  source 1..21: mol_type = other RNA
ccaggaatcttaagaaaatat

SEQ ID NO: 73 - RNA, 21 nt, synthetic construct
  source 1..21: mol_type = other RNA
tcagcatttggataatttctt

SEQ ID NO: 74 - RNA, 21 nt, synthetic construct
  source 1..21: mol_type = other RNA
tacgaagatgagtccttcact

SEQ ID NO: 75 - RNA, 21 nt, synthetic construct
  source 1..21: mol_type = other RNA
caccaaacatacagtgaatct

SEQ ID NO: 76 - RNA, 21 nt, synthetic construct
  source 1..21: mol_type = other RNA
acactcaaaatcgtgttcaat

SEQ ID NO: 77 - RNA, 21 nt, synthetic construct
  source 1..21: mol_type = other RNA
atgaagtcaactcttctttct

SEQ ID NO: 78 - RNA, 21 nt, synthetic construct
  source 1..21: mol_type = other RNA
taacaagaccatactacagtt

SEQ ID NO: 79 - RNA, 21 nt, synthetic construct
  source 1..21: mol_type = other RNA
aataggactacttctaatctt

SEQ ID NO: 80 - RNA, 21 nt, synthetic construct
  source 1..21: mol_type = other RNA
aaacatcatgagcactatcat

SEQ ID NO: 81 - RNA, 21 nt, synthetic construct
  source 1..21: mol_type = other RNA
cattcatctatggaaagaggt

SEQ ID NO: 82 - RNA, 21 nt, synthetic construct
  source 1..21: mol_type = other RNA
taacttccatgaattctagtt

SEQ ID NO: 83 - RNA, 21 nt, synthetic construct
  source 1..21: mol_type = other RNA
gactatgattaccagaacagt

SEQ ID NO: 84 - RNA, 21 nt, synthetic construct
  source 1..21: mol_type = other RNA
ccgaaactcatcattgaatct

SEQ ID NO: 85 - RNA, 21 nt, synthetic construct
  source 1..21: mol_type = other RNA
actgaattcgtttcttcaaat

SEQ ID NO: 86 - RNA, 21 nt, synthetic construct
  source 1..21: mol_type = other RNA
gttggttcaaattattcttct

SEQ ID NO: 87 - RNA, 21 nt, synthetic construct
  source 1..21: mol_type = other RNA
agttcactgtcaataaccttt

SEQ ID NO: 88 - RNA, 21 nt, synthetic construct
  source 1..21: mol_type = other RNA
actcagttctcaattcttcct

SEQ ID NO: 89 - RNA, 21 nt, synthetic construct
  source 1..21: mol_type = other RNA
tacgtctactttcacttggtt

SEQ ID NO: 90 - RNA, 21 nt, synthetic construct
  source 1..21: mol_type = other RNA
ggatgaaattactagcacatt

SEQ ID NO: 91 - RNA, 21 nt, synthetic construct
  source 1..21: mol_type = other RNA
gttactcttaaaacaaagtat

SEQ ID NO: 92 - RNA, 21 nt, synthetic construct
  source 1..21: mol_type = other RNA
ctgatgaagacacagctgttt

SEQ ID NO: 93 - RNA, 21 nt, synthetic construct
  source 1..21: mol_type = other RNA
ctagagttagacataaatctt

SEQ ID NO: 94 - RNA, 21 nt, synthetic construct
  source 1..21: mol_type = other RNA
ctctacaagtaagacaggatt

SEQ ID NO: 95 - RNA, 21 nt, synthetic construct
  source 1..21: mol_type = other RNA
tttctcattaagacacgaaat

SEQ ID NO: 96 - RNA, 21 nt, synthetic construct
  source 1..21: mol_type = other RNA
tgaagcctacaacacattttt

SEQ ID NO: 97 - RNA, 21 nt, synthetic construct
  source 1..21: mol_type = other RNA
aatccaatgaaacatctcttt

SEQ ID NO: 98 - RNA, 21 nt, synthetic construct
  source 1..21: mol_type = other RNA
ataatcagaattcctcaaatt

SEQ ID NO: 99 - RNA, 21 nt, synthetic construct
  source 1..21: mol_type = other RNA
aggaacactatcaaacattct

SEQ ID NO: 100 - RNA, 21 nt, synthetic construct
  source 1..21: mol_type = other RNA
tcaaatgcactctacttcagt

SEQ ID NO: 101 - RNA, 21 nt, synthetic construct
  source 1..21: mol_type = other RNA
tcagtgaaatgcttgagtatt

SEQ ID NO: 102 - RNA, 21 nt, synthetic construct
  source 1..21: mol_type = other RNA
tcctcagaacatgaagtctgt

SEQ ID NO: 103 - RNA, 21 nt, synthetic construct
  source 1..21: mol_type = other RNA
ctcattcagagaaacctttct

SEQ ID NO: 104 - RNA, 21 nt, synthetic construct
  source 1..21: mol_type = other RNA
acaaccctttctctagacttt

SEQ ID NO: 105 - RNA, 21 nt, synthetic construct
  source 1..21: mol_type = other RNA
ctccagaactcagtcaaacat

SEQ ID NO: 106 - RNA, 21 nt, synthetic construct
  source 1..21: mol_type = other RNA
ttgcagatctcagtcaaattt

SEQ ID NO: 107 - RNA, 21 nt, synthetic construct
  source 1..21: mol_type = other RNA
gaccttgatcagatattctat

SEQ ID NO: 108 - RNA, 21 nt, synthetic construct
  source 1..21: mol_type = other RNA
tctgaatctagtcagtcattt

SEQ ID NO: 109 - RNA, 21 nt, synthetic construct
  source 1..21: mol_type = other RNA
ctatcaaaggaatttaatcct

SEQ ID NO: 110 - RNA, 21 nt, synthetic construct
  source 1..21: mol_type = other RNA
tacattgagatcattccaaat

SEQ ID NO: 111 - RNA, 21 nt, synthetic construct
  source 1..21: mol_type = other RNA
actatgctgaaattgattatt

SEQ ID NO: 112 - RNA, 21 nt, synthetic construct
  source 1..21: mol_type = other RNA
taggacaaacatcaactcctt

SEQ ID NO: 113 - RNA, 21 nt, synthetic construct
  source 1..21: mol_type = other RNA
tcggaattcttggtcctattt

SEQ ID NO: 114 - RNA, 21 nt, synthetic construct
  source 1..21: mol_type = other RNA
ttatccaagttcgttttaaat

SEQ ID NO: 115 - RNA, 21 nt, synthetic construct
  source 1..21: mol_type = other RNA
atgctgttcagccaaatagct

SEQ ID NO: 116 - RNA, 21 nt, synthetic construct
  source 1..21: mol_type = other RNA
tagcagttatacctacgtatt

SEQ ID NO: 117 - RNA, 21 nt, synthetic construct
  source 1..21: mol_type = other RNA
ctggttcatttaaaactcttt

SEQ ID NO: 118 - RNA, 21 nt, synthetic construct
  source 1..21: mol_type = other RNA
atatctgattcacagatcaat

SEQ ID NO: 119 - RNA, 21 nt, synthetic construct
  source 1..21: mol_type = other RNA
tcagagtttctgggttactgt

SEQ ID NO: 120 - RNA, 21 nt, synthetic construct
  source 1..21: mol_type = other RNA
agaatttgcctctaaaccttt

SEQ ID NO: 121 - RNA, 21 nt, synthetic construct
  source 1..21: mol_type = other RNA
atgtagcttacagttccaact

SEQ ID NO: 122 - RNA, 21 nt, synthetic construct
  source 1..21: mol_type = other RNA
gaatgtgatgtattttaatgt

SEQ ID NO: 123 - RNA, 21 nt, synthetic construct
  source 1..21: mol_type = other RNA
tagatatattaggatctctct

SEQ ID NO: 124 - RNA, 21 nt, synthetic construct
  source 1..21: mol_type = other RNA
tcacagcttcttcgtttaagt

SEQ ID NO: 125 - RNA, 21 nt, synthetic construct
  source 1..21: mol_type = other RNA
attgatctactcaagatcaat

SEQ ID NO: 126 - RNA, 21 nt, synthetic construct
  source 1..21: mol_type = other RNA
cctctgaaatgtatgtaaagt

SEQ ID NO: 127 - RNA, 21 nt, synthetic construct
  source 1..21: mol_type = other RNA
aaggaaatactaataccaaat

SEQ ID NO: 128 - RNA, 21 nt, synthetic construct
  source 1..21: mol_type = other RNA
cattcctaaaacatggaatct

SEQ ID NO: 129 - RNA, 21 nt, synthetic construct
  source 1..21: mol_type = other RNA
agactctttaagacctcaaat

SEQ ID NO: 130 - RNA, 21 nt, synthetic construct
  source 1..21: mol_type = other RNA
agataatggctattacttctt

SEQ ID NO: 131 - RNA, 21 nt, synthetic construct
  source 1..21: mol_type = other RNA
ttctgcattaatttgaatact

SEQ ID NO: 132 - RNA, 21 nt, synthetic construct
  source 1..21: mol_type = other RNA
aagggcttatctttcttaatt

SEQ ID NO: 133 - RNA, 21 nt, synthetic construct
  source 1..21: mol_type = other RNA
ctcttttaaatcctttacact

SEQ ID NO: 134 - RNA, 21 nt, synthetic construct
  source 1..21: mol_type = other RNA
cactagtaaaacagatattat

SEQ ID NO: 135 - RNA, 21 nt, synthetic construct
  source 1..21: mol_type = other RNA
tttctgactttccatgagtat

SEQ ID NO: 136 - RNA, 21 nt, synthetic construct
  source 1..21: mol_type = other RNA
aaaacataatttcacctactt

SEQ ID NO: 137 - RNA, 21 nt, synthetic construct
  source 1..21: mol_type = other RNA
ctggtctaaatgcagttgttt

SEQ ID NO: 138 - RNA, 21 nt, synthetic construct
  source 1..21: mol_type = other RNA
tctcttcttccagcaacttct

SEQ ID NO: 139 - RNA, 21 nt, synthetic construct
  source 1..21: mol_type = other RNA
tttcatcattcctttccctgt

SEQ ID NO: 140 - RNA, 21 nt, synthetic construct
  source 1..21: mol_type = other RNA
tttagacatccttaaaatcat

SEQ ID NO: 141 - RNA, 21 nt, synthetic construct
  source 1..21: mol_type = other RNA
tgatttaatcatcctgtaact

SEQ ID NO: 142 - RNA, 21 nt, synthetic construct
  source 1..21: mol_type = other RNA
gactaagaaactcactcgaat

SEQ ID NO: 143 - RNA, 21 nt, synthetic construct
  source 1..21: mol_type = other RNA
tcgaaaccacacaactacatt

SEQ ID NO: 144 - RNA, 21 nt, synthetic construct
  source 1..21: mol_type = other RNA
acaacataccagaatctctat

SEQ ID NO: 145 - RNA, 21 nt, synthetic construct
  source 1..21: mol_type = other RNA
gcattctattcgttgtgaact

SEQ ID NO: 146 - RNA, 21 nt, synthetic construct
  source 1..21: mol_type = other RNA
gtctcgattcagtgtagaagt

SEQ ID NO: 147 - RNA, 21 nt, synthetic construct
  source 1..21: mol_type = other RNA
atccacaaaacattggctttt

SEQ ID NO: 148 - RNA, 21 nt, synthetic construct
  source 1..21: mol_type = other RNA
cgtattcccactattcctttt

SEQ ID NO: 149 - RNA, 21 nt, synthetic construct
  source 1..21: mol_type = other RNA
catcaacatttctaagatttt

SEQ ID NO: 150 - RNA, 21 nt, synthetic construct
  source 1..21: mol_type = other RNA
aaaacatttctttgttttctt

SEQ ID NO: 151 - RNA, 21 nt, synthetic construct
  source 1..21: mol_type = other RNA
gtgatctgttcagttgcaaat

SEQ ID NO: 152 - RNA, 21 nt, synthetic construct
  source 1..21: mol_type = other RNA
attcgacatttccatttttct

SEQ ID NO: 153 - RNA, 21 nt, synthetic construct
  source 1..21: mol_type = other RNA
cttctctactctgaaattggt

SEQ ID NO: 154 - RNA, 21 nt, synthetic construct
  source 1..21: mol_type = other RNA
gttattctctacttgagaaat

SEQ ID NO: 155 - RNA, 21 nt, synthetic construct
  source 1..21: mol_type = other RNA
tgttagtgtcagaactgaaat

SEQ ID NO: 156 - RNA, 21 nt, synthetic construct
  source 1..21: mol_type = other RNA
tatccctagacttttagtctt

SEQ ID NO: 157 - RNA, 21 nt, synthetic construct
  source 1..21: mol_type = other RNA
tcttccataaaatgaaacttt

SEQ ID NO: 158 - RNA, 21 nt, synthetic construct
  source 1..21: mol_type = other RNA
atgtttctaatccattgctct

SEQ ID NO: 159 - RNA, 21 nt, synthetic construct
  source 1..21: mol_type = other RNA
gtagacatgaatattaattgt

SEQ ID NO: 160 - RNA, 21 nt, synthetic construct
  source 1..21: mol_type = other RNA
gatctggaaaatacttgtttt

SEQ ID NO: 161 - RNA, 21 nt, synthetic construct
  source 1..21: mol_type = other RNA
ctgtgtagaaatattaaaact

SEQ ID NO: 162 - RNA, 23 nt, synthetic construct
  source 1..23: mol_type = other RNA
agagaagatatgatccactttcc

SEQ ID NO: 163 - RNA, 23 nt, synthetic construct
  source 1..23: mol_type = other RNA
atgttttccaatttggtttgaga

SEQ ID NO: 164 - RNA, 23 nt, synthetic construct
  source 1..23: mol_type = other RNA
aactctaagatgttccacttata

SEQ ID NO: 165 - RNA, 23 nt, synthetic construct
  source 1..23: mol_type = other RNA
aaacttgttgatgttgtcctcaa

SEQ ID NO: 166 - RNA, 23 nt, synthetic construct
  source 1..23: mol_type = other RNA
agaatccaagagtagttatgctc

SEQ ID NO: 167 - RNA, 23 nt, synthetic construct
  source 1..23: mol_type = other RNA
aagttaacatccaagttccaaca

SEQ ID NO: 168 - RNA, 23 nt, synthetic construct
  source 1..23: mol_type = other RNA
agtaagattgaactcttcttctt

SEQ ID NO: 169 - RNA, 23 nt, synthetic construct
  source 1..23: mol_type = other RNA
aacaattatatctgtgtttgaag

SEQ ID NO: 170 - RNA, 23 nt, synthetic construct
  source 1..23: mol_type = other RNA
aaaatcttagatgagttactttg

SEQ ID NO: 171 - RNA, 23 nt, synthetic construct
  source 1..23: mol_type = other RNA
agtatcttggattatttcatagc

SEQ ID NO: 172 - RNA, 23 nt, synthetic construct
  source 1..23: mol_type = other RNA
agaaactggcttttcttcagtct

SEQ ID NO: 173 - RNA, 23 nt, synthetic construct
  source 1..23: mol_type = other RNA
aaattcttgaagaagcaatgact

SEQ ID NO: 174 - RNA, 23 nt, synthetic construct
  source 1..23: mol_type = other RNA
agaaaagtatcattgagagtagg

SEQ ID NO: 175 - RNA, 23 nt, synthetic construct
  source 1..23: mol_type = other RNA
atgtaataatttcttctgtttcc

SEQ ID NO: 176 - RNA, 23 nt, synthetic construct
  source 1..23: mol_type = other RNA
atcacgtttggtaaaagtgctgt

SEQ ID NO: 177 - RNA, 23 nt, synthetic construct
  source 1..23: mol_type = other RNA
aatagtaagacaaattctctcat

SEQ ID NO: 178 - RNA, 23 nt, synthetic construct
  source 1..23: mol_type = other RNA
aaagtgaaccacgtgaatgtctt

SEQ ID NO: 179 - RNA, 23 nt, synthetic construct
  source 1..23: mol_type = other RNA
aactgttaacatttaacacagcg

SEQ ID NO: 180 - RNA, 23 nt, synthetic construct
  source 1..23: mol_type = other RNA
attcactaatagaaaagaaagag

SEQ ID NO: 181 - RNA, 23 nt, synthetic construct
  source 1..23: mol_type = other RNA
aaaaatcatgtgtttgtgaaagt

SEQ ID NO: 182 - RNA, 23 nt, synthetic construct
  source 1..23: mol_type = other RNA
aaagacaggatattttaagtact

SEQ ID NO: 183 - RNA, 23 nt, synthetic construct
  source 1..23: mol_type = other RNA
aaatcattgttatatgggaaaga

SEQ ID NO: 184 - RNA, 23 nt, synthetic construct
  source 1..23: mol_type = other RNA
aacattttgatatatgtacacgt

SEQ ID NO: 185 - RNA, 23 nt, synthetic construct
  source 1..23: mol_type = other RNA
agattgttatgaatttcgttgat

SEQ ID NO: 186 - RNA, 23 nt, synthetic construct
  source 1..23: mol_type = other RNA
acaggtaactctggtagtttcta

SEQ ID NO: 187 - RNA, 23 nt, synthetic construct
  source 1..23: mol_type = other RNA
acatgaatcatgaaaagaaagga

SEQ ID NO: 188 - RNA, 23 nt, synthetic construct
  source 1..23: mol_type = other RNA
aagcattaaatttagcatgcggt

SEQ ID NO: 189 - RNA, 23 nt, synthetic construct
  source 1..23: mol_type = other RNA
aaaataaaggatttcaagagggt

SEQ ID NO: 190 - RNA, 23 nt, synthetic construct
  source 1..23: mol_type = other RNA
agtaaattctagatcaagagaga

SEQ ID NO: 191 - RNA, 23 nt, synthetic construct
  source 1..23: mol_type = other RNA
aattcaaacttgagtttgtgggc

SEQ ID NO: 192 - RNA, 23 nt, synthetic construct
  source 1..23: mol_type = other RNA
aaaaggaagttacagaaagattc

SEQ ID NO: 193 - RNA, 23 nt, synthetic construct
  source 1..23: mol_type = other RNA
aaagaagtcctgaaatggtagat

SEQ ID NO: 194 - RNA, 23 nt, synthetic construct
  source 1..23: mol_type = other RNA
ataaagtgaacttttatgatgtc

SEQ ID NO: 195 - RNA, 23 nt, synthetic construct
  source 1..23: mol_type = other RNA
atactgtacctaattccttgagg

SEQ ID NO: 196 - RNA, 23 nt, synthetic construct
  source 1..23: mol_type = other RNA
aaatgtgtggtcaaggtaagaag

SEQ ID NO: 197 - RNA, 23 nt, synthetic construct
  source 1..23: mol_type = other RNA
aggagtaatagatgtgtgtgagg

SEQ ID NO: 198 - RNA, 23 nt, synthetic construct
  source 1..23: mol_type = other RNA
aagttgaaatcctcgatcagatt

SEQ ID NO: 199 - RNA, 23 nt, synthetic construct
  source 1..23: mol_type = other RNA
aagtagcacgatttgcttgtcaa

SEQ ID NO: 200 - RNA, 23 nt, synthetic construct
  source 1..23: mol_type = other RNA
aattgactgtgtacattagggat

SEQ ID NO: 201 - RNA, 23 nt, synthetic construct
  source 1..23: mol_type = other RNA
atgaaatgaatggagaataattc

SEQ ID NO: 202 - RNA, 23 nt, synthetic construct
  source 1..23: mol_type = other RNA
attaatgtcaatgtaagcctgca

SEQ ID NO: 203 - RNA, 23 nt, synthetic construct
  source 1..23: mol_type = other RNA
atattttcttaagattcctggtt

SEQ ID NO: 204 - RNA, 23 nt, synthetic construct
  source 1..23: mol_type = other RNA
aagaaattatccaaatgctgaga

SEQ ID NO: 205 - RNA, 23 nt, synthetic construct
  source 1..23: mol_type = other RNA
agtgaaggactcatcttcgtact

SEQ ID NO: 206 - RNA, 23 nt, synthetic construct
  source 1..23: mol_type = other RNA
agattcactgtatgtttggtgaa

SEQ ID NO: 207 - RNA, 23 nt, synthetic construct
  source 1..23: mol_type = other RNA
attgaacacgattttgagtgtgt

SEQ ID NO: 208 - RNA, 23 nt, synthetic construct
  source 1..23: mol_type = other RNA
agaaagaagagttgacttcatct

SEQ ID NO: 209 - RNA, 23 nt, synthetic construct
  source 1..23: mol_type = other RNA
aactgtagtatggtcttgttaag

SEQ ID NO: 210 - RNA, 23 nt, synthetic construct
  source 1..23: mol_type = other RNA
aagattagaagtagtcctattag

SEQ ID NO: 211 - RNA, 23 nt, synthetic construct
  source 1..23: mol_type = other RNA
atgatagtgctcatgatgtttga

SEQ ID NO: 212 - RNA, 23 nt, synthetic construct
  source 1..23: mol_type = other RNA
acctctttccatagatgaatgag

SEQ ID NO: 213 - RNA, 23 nt, synthetic construct
  source 1..23: mol_type = other RNA
aactagaattcatggaagttaac

SEQ ID NO: 214 - RNA, 23 nt, synthetic construct
  source 1..23: mol_type = other RNA
actgttctggtaatcatagtcag

SEQ ID NO: 215 - RNA, 23 nt, synthetic construct
  source 1..23: mol_type = other RNA
agattcaatgatgagtttcggaa

SEQ ID NO: 216 - RNA, 23 nt, synthetic construct
  source 1..23: mol_type = other RNA
atttgaagaaacgaattcagtgc

SEQ ID NO: 217 - RNA, 23 nt, synthetic construct
  source 1..23: mol_type = other RNA
agaagaataatttgaaccaacaa

SEQ ID NO: 218 - RNA, 23 nt, synthetic construct
  source 1..23: mol_type = other RNA
aaaggttattgacagtgaactta

SEQ ID NO: 219 - RNA, 23 nt, synthetic construct
  source 1..23: mol_type = other RNA
aggaagaattgagaactgagttc

SEQ ID NO: 220 - RNA, 23 nt, synthetic construct
  source 1..23: mol_type = other RNA
aaccaagtgaaagtagacgtatc

SEQ ID NO: 221 - RNA, 23 nt, synthetic construct
  source 1..23: mol_type = other RNA
aatgtgctagtaatttcatccag

SEQ ID NO: 222 - RNA, 23 nt, synthetic construct
  source 1..23: mol_type = other RNA
atactttgttttaagagtaacag

SEQ ID NO: 223 - RNA, 23 nt, synthetic construct
  source 1..23: mol_type = other RNA
aaacagctgtgtcttcatcagta

SEQ ID NO: 224 - RNA, 23 nt, synthetic construct
  source 1..23: mol_type = other RNA
aagatttatgtctaactctagga

SEQ ID NO: 225 - RNA, 23 nt, synthetic construct
  source 1..23: mol_type = other RNA
aatcctgtcttacttgtagagat

SEQ ID NO: 226 - RNA, 23 nt, synthetic construct
  source 1..23: mol_type = other RNA
atttcgtgtcttaatgagaaact

SEQ ID NO: 227 - RNA, 23 nt, synthetic construct
  source 1..23: mol_type = other RNA
aaaaatgtgttgtaggcttcact

SEQ ID NO: 228 - RNA, 23 nt, synthetic construct
  source 1..23: mol_type = other RNA
aaagagatgtttcattggattta

SEQ ID NO: 229 - RNA, 23 nt, synthetic construct
  source 1..23: mol_type = other RNA
aatttgaggaattctgattatgg

SEQ ID NO: 230 - RNA, 23 nt, synthetic construct
  source 1..23: mol_type = other RNA
agaatgtttgatagtgttcctct

SEQ ID NO: 231 - RNA, 23 nt, synthetic construct
  source 1..23: mol_type = other RNA
actgaagtagagtgcatttgatc

SEQ ID NO: 232 - RNA, 23 nt, synthetic construct
  source 1..23: mol_type = other RNA
aatactcaagcatttcactgagc

SEQ ID NO: 233 - RNA, 23 nt, synthetic construct
  source 1..23: mol_type = other RNA
acagacttcatgttctgaggaag

SEQ ID NO: 234 - RNA, 23 nt, synthetic construct
  source 1..23: mol_type = other RNA
agaaaggtttctctgaatgagtt

SEQ ID NO: 235 - RNA, 23 nt, synthetic construct
  source 1..23: mol_type = other RNA
aaagtctagagaaagggttgtat

SEQ ID NO: 236 - RNA, 23 nt, synthetic construct
  source 1..23: mol_type = other RNA
atgtttgactgagttctggagag

SEQ ID NO: 237 - RNA, 23 nt, synthetic construct
  source 1..23: mol_type = other RNA
aaatttgactgagatctgcaaag

SEQ ID NO: 238 - RNA, 23 nt, synthetic construct
  source 1..23: mol_type = other RNA
atagaatatctgatcaaggtctg

SEQ ID NO: 239 - RNA, 23 nt, synthetic construct
  source 1..23: mol_type = other RNA
aaatgactgactagattcagaag

SEQ ID NO: 240 - RNA, 23 nt, synthetic construct
  source 1..23: mol_type = other RNA
aggattaaattcctttgatagaa

SEQ ID NO: 241 - RNA, 23 nt, synthetic construct
  source 1..23: mol_type = other RNA
atttggaatgatctcaatgtaat

SEQ ID NO: 242 - RNA, 23 nt, synthetic construct
  source 1..23: mol_type = other RNA
aataatcaatttcagcatagtca

SEQ ID NO: 243 - RNA, 23 nt, synthetic construct
  source 1..23: mol_type = other RNA
aaggagttgatgtttgtcctaac

SEQ ID NO: 244 - RNA, 23 nt, synthetic construct
  source 1..23: mol_type = other RNA
aaataggaccaagaattccgaga

SEQ ID NO: 245 - RNA, 23 nt, synthetic construct
  source 1..23: mol_type = other RNA
atttaaaacgaacttggataaca

SEQ ID NO: 246 - RNA, 23 nt, synthetic construct
  source 1..23: mol_type = other RNA
agctatttggctgaacagcatta

SEQ ID NO: 247 - RNA, 23 nt, synthetic construct
  source 1..23: mol_type = other RNA
aatacgtaggtataactgctatt

SEQ ID NO: 248 - RNA, 23 nt, synthetic construct
  source 1..23: mol_type = other RNA
aaagagttttaaatgaaccaggc

SEQ ID NO: 249 - RNA, 23 nt, synthetic construct
  source 1..23: mol_type = other RNA
attgatctgtgaatcagatatga

SEQ ID NO: 250 - RNA, 23 nt, synthetic construct
  source 1..23: mol_type = other RNA
acagtaacccagaaactctgaag

SEQ ID NO: 251 - RNA, 23 nt, synthetic construct
  source 1..23: mol_type = other RNA
aaaggtttagaggcaaattctgc

SEQ ID NO: 252 - RNA, 23 nt, synthetic construct
  source 1..23: mol_type = other RNA
agttggaactgtaagctacatag

SEQ ID NO: 253 - RNA, 23 nt, synthetic construct
  source 1..23: mol_type = other RNA
acattaaaatacatcacattcct

SEQ ID NO: 254 - RNA, 23 nt, synthetic construct
  source 1..23: mol_type = other RNA
agagagatcctaatatatctagc

SEQ ID NO: 255 - RNA, 23 nt, synthetic construct
  source 1..23: mol_type = other RNA
acttaaacgaagaagctgtgatt

SEQ ID NO: 256 - RNA, 23 nt, synthetic construct
  source 1..23: mol_type = other RNA
attgatcttgagtagatcaattt

SEQ ID NO: 257 - RNA, 23 nt, synthetic construct
  source 1..23: mol_type = other RNA
actttacatacatttcagaggac

SEQ ID NO: 258 - RNA, 23 nt, synthetic construct
  source 1..23: mol_type = other RNA
atttggtattagtatttccttca

SEQ ID NO: 259 - RNA, 23 nt, synthetic construct
  source 1..23: mol_type = other RNA
agattccatgttttaggaatgac

SEQ ID NO: 260 - RNA, 23 nt, synthetic construct
  source 1..23: mol_type = other RNA
atttgaggtcttaaagagtctct

SEQ ID NO: 261 - RNA, 23 nt, synthetic construct
  source 1..23: mol_type = other RNA
aagaagtaatagccattatctta

SEQ ID NO: 262 - RNA, 23 nt, synthetic construct
  source 1..23: mol_type = other RNA
agtattcaaattaatgcagaagt

SEQ ID NO: 263 - RNA, 23 nt, synthetic construct
  source 1..23: mol_type = other RNA
aattaagaaagataagccctttt

SEQ ID NO: 264 - RNA, 23 nt, synthetic construct
  source 1..23: mol_type = other RNA
agtgtaaaggatttaaaagagtt

SEQ ID NO: 265 - RNA, 23 nt, synthetic construct
  source 1..23: mol_type = other RNA
ataatatctgttttactagtgtg

SEQ ID NO: 266 - RNA, 23 nt, synthetic construct
  source 1..23: mol_type = other RNA
atactcatggaaagtcagaaaaa

SEQ ID NO: 267 - RNA, 23 nt, synthetic construct
  source 1..23: mol_type = other RNA
aagtaggtgaaattatgttttga

SEQ ID NO: 268 - RNA, 23 nt, synthetic construct
  source 1..23: mol_type = other RNA
aaacaactgcatttagaccagca

SEQ ID NO: 269 - RNA, 23 nt, synthetic construct
  source 1..23: mol_type = other RNA
agaagttgctggaagaagagaga

SEQ ID NO: 270 - RNA, 23 nt, synthetic construct
  source 1..23: mol_type = other RNA
acagggaaaggaatgatgaaagg

SEQ ID NO: 271 - RNA, 23 nt, synthetic construct
  source 1..23: mol_type = other RNA
atgattttaaggatgtctaaagg

SEQ ID NO: 272 - RNA, 23 nt, synthetic construct
  source 1..23: mol_type = other RNA
agttacaggatgattaaatcaag

SEQ ID NO: 273 - RNA, 23 nt, synthetic construct
  source 1..23: mol_type = other RNA
attcgagtgagtttcttagtcct

SEQ ID NO: 274 - RNA, 23 nt, synthetic construct
  source 1..23: mol_type = other RNA
aatgtagttgtgtggtttcgagt

SEQ ID NO: 275 - RNA, 23 nt, synthetic construct
  source 1..23: mol_type = other RNA
atagagattctggtatgttgtct

SEQ ID NO: 276 - RNA, 23 nt, synthetic construct
  source 1..23: mol_type = other RNA
agttcacaacgaatagaatgcag

SEQ ID NO: 277 - RNA, 23 nt, synthetic construct
  source 1..23: mol_type = other RNA
acttctacactgaatcgagactg

SEQ ID NO: 278 - RNA, 23 nt, synthetic construct
  source 1..23: mol_type = other RNA
aaaagccaatgttttgtggatgt

SEQ ID NO: 279 - RNA, 23 nt, synthetic construct
  source 1..23: mol_type = other RNA
aaaaggaatagtgggaatacgaa

SEQ ID NO: 280 - RNA, 23 nt, synthetic construct
  source 1..23: mol_type = other RNA
aaaatcttagaaatgttgatggg

SEQ ID NO: 281 - RNA, 23 nt, synthetic construct
  source 1..23: mol_type = other RNA
aagaaaacaaagaaatgttttcc

SEQ ID NO: 282 - RNA, 23 nt, synthetic construct
  source 1..23: mol_type = other RNA
atttgcaactgaacagatcacac

SEQ ID NO: 283 - RNA, 23 nt, synthetic construct
  source 1..23: mol_type = other RNA
agaaaaatggaaatgtcgaattc

SEQ ID NO: 284 - RNA, 23 nt, synthetic construct
  source 1..23: mol_type = other RNA
accaatttcagagtagagaagcc

SEQ ID NO: 285 - RNA, 23 nt, synthetic construct
  source 1..23: mol_type = other RNA
atttctcaagtagagaataacga

SEQ ID NO: 286 - RNA, 23 nt, synthetic construct
  source 1..23: mol_type = other RNA
atttcagttctgacactaacaag

SEQ ID NO: 287 - RNA, 23 nt, synthetic construct
  source 1..23: mol_type = other RNA
aagactaaaagtctagggatatg

SEQ ID NO: 288 - RNA, 23 nt, synthetic construct
  source 1..23: mol_type = other RNA
aaagtttcattttatggaagaga

SEQ ID NO: 289 - RNA, 23 nt, synthetic construct
  source 1..23: mol_type = other RNA
agagcaatggattagaaacatta

SEQ ID NO: 290 - RNA, 23 nt, synthetic construct
  source 1..23: mol_type = other RNA
acaattaatattcatgtctacct

SEQ ID NO: 291 - RNA, 23 nt, synthetic construct
  source 1..23: mol_type = other RNA
aaaacaagtattttccagatcaa

SEQ ID NO: 292 - RNA, 23 nt, synthetic construct
  source 1..23: mol_type = other RNA
agttttaatatttctacacagca

SEQ ID NO: 293 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagtggatcatatcttctct

SEQ ID NO: 294 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaaaccaaattggaaaacat

SEQ ID NO: 295 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taagtggaacatcttagagtt

SEQ ID NO: 296 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggacaacatcaacaagttt

SEQ ID NO: 297 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcataactactcttggattct

SEQ ID NO: 298 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttggaacttggatgttaactt

SEQ ID NO: 299 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagaagagttcaatcttact

SEQ ID NO: 300 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaaacacagatataattgtt

SEQ ID NO: 301 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagtaactcatctaagatttt

SEQ ID NO: 302 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgaaataatccaagatact

SEQ ID NO: 303 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actgaagaaaagccagtttct

SEQ ID NO: 304 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcattgcttcttcaagaattt

SEQ ID NO: 305 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tactctcaatgatacttttct

SEQ ID NO: 306 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaacagaagaaattattacat

SEQ ID NO: 307 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcacttttaccaaacgtgat

SEQ ID NO: 308 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagagaatttgtcttactatt

SEQ ID NO: 309 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacattcacgtggttcacttt

SEQ ID NO: 310 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtgttaaatgttaacagtt

SEQ ID NO: 311 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acagttttccactatttctct

SEQ ID NO: 312 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctttcttttctattagtgaat

SEQ ID NO: 313 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttcacaaacacatgattttt

SEQ ID NO: 314 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacttaaaatatcctgtcttt

SEQ ID NO: 315 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttcccatataacaatgattt

SEQ ID NO: 316 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgtacatatatcaaaatgtt

SEQ ID NO: 317 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caacgaaattcataacaatct

SEQ ID NO: 318 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaactaccagagttacctgt

SEQ ID NO: 319 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctttcttttcatgattcatgt

SEQ ID NO: 320 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatgctaaatttaatgctt

SEQ ID NO: 321 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctcttgaaatcctttatttt

SEQ ID NO: 322 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctcttgatctagaatttact

SEQ ID NO: 323 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccacaaactcaagtttgaatt

SEQ ID NO: 324 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctttctgtaacttcctttt

SEQ ID NO: 325 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtatgaaccatattttaagt

SEQ ID NO: 326 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctaccatttcaggacttcttt

SEQ ID NO: 327 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catcataaaagttcactttat

SEQ ID NO: 328 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaaggaattaggtacagtat

SEQ ID NO: 329 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcttaccttgaccacacattt

SEQ ID NO: 330 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcacacacatctattactcct

SEQ ID NO: 331 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctgatcgaggatttcaactt

SEQ ID NO: 332 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacaagcaaatcgtgctactt

SEQ ID NO: 333 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccctaatgtacacagtcaatt

SEQ ID NO: 334 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attattctccattcatttcat

SEQ ID NO: 335 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggcttacattgacattaat

SEQ ID NO: 336 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaggaatcttaagaaaatat

SEQ ID NO: 337 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcagcatttggataatttctt

SEQ ID NO: 338 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacgaagatgagtccttcact

SEQ ID NO: 339 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caccaaacatacagtgaatct

SEQ ID NO: 340 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acactcaaaatcgtgttcaat

SEQ ID NO: 341 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgaagtcaactcttctttct

SEQ ID NO: 342 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taacaagaccatactacagtt

SEQ ID NO: 343 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataggactacttctaatctt

SEQ ID NO: 344 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaacatcatgagcactatcat

SEQ ID NO: 345 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cattcatctatggaaagaggt

SEQ ID NO: 346 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taacttccatgaattctagtt

SEQ ID NO: 347 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactatgattaccagaacagt

SEQ ID NO: 348 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccgaaactcatcattgaatct

SEQ ID NO: 349 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actgaattcgtttcttcaaat

SEQ ID NO: 350 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttggttcaaattattcttct

SEQ ID NO: 351 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agttcactgtcaataaccttt

SEQ ID NO: 352 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actcagttctcaattcttcct

SEQ ID NO: 353 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacgtctactttcacttggtt

SEQ ID NO: 354 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggatgaaattactagcacatt

SEQ ID NO: 355 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttactcttaaaacaaagtat

SEQ ID NO: 356 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgatgaagacacagctgttt

SEQ ID NO: 357 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctagagttagacataaatctt

SEQ ID NO: 358 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctctacaagtaagacaggatt

SEQ ID NO: 359 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttctcattaagacacgaaat

SEQ ID NO: 360 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaagcctacaacacattttt

SEQ ID NO: 361 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatccaatgaaacatctcttt

SEQ ID NO: 362 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ataatcagaattcctcaaatt

SEQ ID NO: 363 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggaacactatcaaacattct

SEQ ID NO: 364 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaaatgcactctacttcagt

SEQ ID NO: 365 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcagtgaaatgcttgagtatt

SEQ ID NO: 366 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcctcagaacatgaagtctgt

SEQ ID NO: 367 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctcattcagagaaacctttct

SEQ ID NO: 368 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaaccctttctctagacttt

SEQ ID NO: 369 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctccagaactcagtcaaacat

SEQ ID NO: 370 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgcagatctcagtcaaattt

SEQ ID NO: 371 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaccttgatcagatattctat

SEQ ID NO: 372 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctgaatctagtcagtcattt

SEQ ID NO: 373 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctatcaaaggaatttaatcct

SEQ ID NO: 374 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacattgagatcattccaaat

SEQ ID NO: 375 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actatgctgaaattgattatt

SEQ ID NO: 376 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taggacaaacatcaactcctt

SEQ ID NO: 377 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcggaattcttggtcctattt

SEQ ID NO: 378 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatccaagttcgttttaaat

SEQ ID NO: 379 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgctgttcagccaaatagct

SEQ ID NO: 380 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagcagttatacctacgtatt

SEQ ID NO: 381 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggttcatttaaaactcttt

SEQ ID NO: 382 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcaaacgccatttcttatct

SEQ ID NO: 383 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atatctgattcacagatcaat

SEQ ID NO: 384 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcagagtttctgggttactgt

SEQ ID NO: 385 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaatttgcctctaaaccttt

SEQ ID NO: 386 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtagcttacagttccaact

SEQ ID NO: 387 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaatgtgatgtattttaatgt

SEQ ID NO: 388 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagatatattaggatctctct

SEQ ID NO: 389 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcacagcttcttcgtttaagt

SEQ ID NO: 390 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgatctactcaagatcaat

SEQ ID NO: 391 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctctgaaatgtatgtaaagt

SEQ ID NO: 392 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaggaaatactaataccaaat

SEQ ID NO: 393 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cattcctaaaacatggaatct

SEQ ID NO: 394 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agactctttaagacctcaaat

SEQ ID NO: 395 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agataatggctattacttctt

SEQ ID NO: 396 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttctgcattaatttgaatact

SEQ ID NO: 397 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagggcttatctttcttaatt

SEQ ID NO: 398 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctcttttaaatcctttacact

SEQ ID NO: 399 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cactagtaaaacagatattat

SEQ ID NO: 400 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttctgactttccatgagtat

SEQ ID NO: 401 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaacataatttcacctactt

SEQ ID NO: 402 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggtctaaatgcagttgttt

SEQ ID NO: 403 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctcttcttccagcaacttct

SEQ ID NO: 404 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttcatcattcctttccctgt

SEQ ID NO: 405 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttagacatccttaaaatcat

SEQ ID NO: 406 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatttaatcatcctgtaact

SEQ ID NO: 407 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactaagaaactcactcgaat

SEQ ID NO: 408 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcgaaaccacacaactacatt

SEQ ID NO: 409 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaacataccagaatctctat

SEQ ID NO: 410 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcattctattcgttgtgaact

SEQ ID NO: 411 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctcgattcagtgtagaagt

SEQ ID NO: 412 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atccacaaaacattggctttt

SEQ ID NO: 413 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgtattcccactattcctttt

SEQ ID NO: 414 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catcaacatttctaagatttt

SEQ ID NO: 415 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaacatttctttgttttctt

SEQ ID NO: 416 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgatctgttcagttgcaaat

SEQ ID NO: 417 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attcgacatttccatttttct

SEQ ID NO: 418 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttctctactctgaaattggt

SEQ ID NO: 419 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttattctctacttgagaaat

SEQ ID NO: 420 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgttagtgtcagaactgaaat

SEQ ID NO: 421 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatccctagacttttagtctt

SEQ ID NO: 422 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcttccataaaatgaaacttt

SEQ ID NO: 423 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtttctaatccattgctct

SEQ ID NO: 424 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtagacatgaatattaattgt

SEQ ID NO: 425 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatctggaaaatacttgtttt

SEQ ID NO: 426 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtgtagaaatattaaaact

SEQ ID NO: 427 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
agagaagatatgatccactttcc

SEQ ID NO: 428 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
atgttttccaatttggtttgaga

SEQ ID NO: 429 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aactctaagatgttccacttata

SEQ ID NO: 430 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
aaacttgttgatgttgtcctcaa

SEQ ID NO: 431 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agaatccaagagtagttatgctc

SEQ ID NO: 432 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aagttaacatccaagttccaaca

SEQ ID NO: 433 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
agtaagattgaactcttcttctt

SEQ ID NO: 434 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aacaattatatctgtgtttgaag

SEQ ID NO: 435 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaatcttagatgagttactttg

SEQ ID NO: 436 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
agtatcttggattatttcatagc

SEQ ID NO: 437 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
agaaactggcttttcttcagtct

SEQ ID NO: 438 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aaattcttgaagaagcaatgact

SEQ ID NO: 439 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
agaaaagtatcattgagagtagg

SEQ ID NO: 440 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
atgtaataatttcttctgtttcc

SEQ ID NO: 441 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
atcacgtttggtaaaagtgctgt

SEQ ID NO: 442 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aatagtaagacaaattctctcat

SEQ ID NO: 443 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
aaagtgaaccacgtgaatgtctt

SEQ ID NO: 444 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
aactgttaacatttaacacagcg

SEQ ID NO: 445 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
agagaaatagtggaaaactgtta

SEQ ID NO: 446 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
attcactaatagaaaagaaagag

SEQ ID NO: 447 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aaaaatcatgtgtttgtgaaagt

SEQ ID NO: 448 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aaagacaggatattttaagtact

SEQ ID NO: 449 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aaatcattgttatatgggaaaga

SEQ ID NO: 450 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aacattttgatatatgtacacgt

SEQ ID NO: 451 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
agattgttatgaatttcgttgat

SEQ ID NO: 452 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyladenosine
acaggtaactctggtagtttcta

SEQ ID NO: 453 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acatgaatcatgaaaagaaagga

SEQ ID NO: 454 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aagcattaaatttagcatgcggt

SEQ ID NO: 455 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aaaataaaggatttcaagagggt

SEQ ID NO: 456 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
agtaaattctagatcaagagaga

SEQ ID NO: 457 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aattcaaacttgagtttgtgggc

SEQ ID NO: 458 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
aaaaggaagttacagaaagattc

SEQ ID NO: 459 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
acttaaaatatggttcatactct

SEQ ID NO: 460 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aaagaagtcctgaaatggtagat

SEQ ID NO: 461 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ataaagtgaacttttatgatgtc

SEQ ID NO: 462 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atactgtacctaattccttgagg

SEQ ID NO: 463 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aaatgtgtggtcaaggtaagaag

SEQ ID NO: 464 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
aggagtaatagatgtgtgtgagg

SEQ ID NO: 465 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
aagttgaaatcctcgatcagatt

SEQ ID NO: 466 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
aagtagcacgatttgcttgtcaa

SEQ ID NO: 467 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aattgactgtgtacattagggat

SEQ ID NO: 468 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
atgaaatgaatggagaataattc

SEQ ID NO: 469 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
attaatgtcaatgtaagcctgca

SEQ ID NO: 470 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
atattttcttaagattcctggtt

SEQ ID NO: 471 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aagaaattatccaaatgctgaga

SEQ ID NO: 472 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
agtgaaggactcatcttcgtact

SEQ ID NO: 473 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agattcactgtatgtttggtgaa

SEQ ID NO: 474 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
attgaacacgattttgagtgtgt

SEQ ID NO: 475 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
agaaagaagagttgacttcatct

SEQ ID NO: 476 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aactgtagtatggtcttgttaag

SEQ ID NO: 477 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aagattagaagtagtcctattag

SEQ ID NO: 478 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
atgatagtgctcatgatgtttga

SEQ ID NO: 479 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
acctctttccatagatgaatgag

SEQ ID NO: 480 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
aactagaattcatggaagttaac

SEQ ID NO: 481 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
actgttctggtaatcatagtcag

SEQ ID NO: 482 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agattcaatgatgagtttcggaa

SEQ ID NO: 483 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
atttgaagaaacgaattcagtgc

SEQ ID NO: 484 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaagaataatttgaaccaacaa

SEQ ID NO: 485 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aaaggttattgacagtgaactta

SEQ ID NO: 486 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
aggaagaattgagaactgagttc

SEQ ID NO: 487 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
aaccaagtgaaagtagacgtatc

SEQ ID NO: 488 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aatgtgctagtaatttcatccag

SEQ ID NO: 489 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
atactttgttttaagagtaacag

SEQ ID NO: 490 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aaacagctgtgtcttcatcagta

SEQ ID NO: 491 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aagatttatgtctaactctagga

SEQ ID NO: 492 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aatcctgtcttacttgtagagat

SEQ ID NO: 493 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
atttcgtgtcttaatgagaaact

SEQ ID NO: 494 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aaaaatgtgttgtaggcttcact

SEQ ID NO: 495 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aaagagatgtttcattggattta

SEQ ID NO: 496 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
aatttgaggaattctgattatgg

SEQ ID NO: 497 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
agaatgtttgatagtgttcctct

SEQ ID NO: 498 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
actgaagtagagtgcatttgatc

SEQ ID NO: 499 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aatactcaagcatttcactgagc

SEQ ID NO: 500 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
acagacttcatgttctgaggaag

SEQ ID NO: 501 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
agaaaggtttctctgaatgagtt

SEQ ID NO: 502 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aaagtctagagaaagggttgtat

SEQ ID NO: 503 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
atgtttgactgagttctggagag

SEQ ID NO: 504 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aaatttgactgagatctgcaaag

SEQ ID NO: 505 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
atagaatatctgatcaaggtctg

SEQ ID NO: 506 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aaatgactgactagattcagaag

SEQ ID NO: 507 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
aggattaaattcctttgatagaa

SEQ ID NO: 508 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
atttggaatgatctcaatgtaat

SEQ ID NO: 509 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aataatcaatttcagcatagtca

SEQ ID NO: 510 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
aaggagttgatgtttgtcctaac

SEQ ID NO: 511 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aaataggaccaagaattccgaga

SEQ ID NO: 512 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
atttaaaacgaacttggataaca

SEQ ID NO: 513 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
agctatttggctgaacagcatta

SEQ ID NO: 514 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
aatacgtaggtataactgctatt

SEQ ID NO: 515 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aaagagttttaaatgaaccaggc

SEQ ID NO: 516 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agataagaaatggcgtttgcatc

SEQ ID NO: 517 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
attgatctgtgaatcagatatga

SEQ ID NO: 518 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
acagtaacccagaaactctgaag

SEQ ID NO: 519 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aaaggtttagaggcaaattctgc

SEQ ID NO: 520 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
agttggaactgtaagctacatag

SEQ ID NO: 521 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
acattaaaatacatcacattcct

SEQ ID NO: 522 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
agagagatcctaatatatctagc

SEQ ID NO: 523 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
acttaaacgaagaagctgtgatt

SEQ ID NO: 524 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
attgatcttgagtagatcaattt

SEQ ID NO: 525 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
actttacatacatttcagaggac

SEQ ID NO: 526 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
atttggtattagtatttccttca

SEQ ID NO: 527 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
agattccatgttttaggaatgac

SEQ ID NO: 528 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
atttgaggtcttaaagagtctct

SEQ ID NO: 529 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aagaagtaatagccattatctta

SEQ ID NO: 530 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agtattcaaattaatgcagaagt

SEQ ID NO: 531 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
aattaagaaagataagccctttt

SEQ ID NO: 532 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
agtgtaaaggatttaaaagagtt

SEQ ID NO: 533 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
ataatatctgttttactagtgtg

SEQ ID NO: 534 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
atactcatggaaagtcagaaaaa

SEQ ID NO: 535 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aagtaggtgaaattatgttttga

SEQ ID NO: 536 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aaacaactgcatttagaccagca

SEQ ID NO: 537 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
agaagttgctggaagaagagaga

SEQ ID NO: 538 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
acagggaaaggaatgatgaaagg

SEQ ID NO: 539 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atgattttaaggatgtctaaagg

SEQ ID NO: 540 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
agttacaggatgattaaatcaag

SEQ ID NO: 541 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
attcgagtgagtttcttagtcct

SEQ ID NO: 542 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aatgtagttgtgtggtttcgagt

SEQ ID NO: 543 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
atagagattctggtatgttgtct

SEQ ID NO: 544 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
agttcacaacgaatagaatgcag

SEQ ID NO: 545 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
acttctacactgaatcgagactg

SEQ ID NO: 546 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aaaagccaatgttttgtggatgt

SEQ ID NO: 547 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
aaaaggaatagtgggaatacgaa

SEQ ID NO: 548 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
aaaatcttagaaatgttgatggg

SEQ ID NO: 549 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
aagaaaacaaagaaatgttttcc

SEQ ID NO: 550 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
atttgcaactgaacagatcacac

SEQ ID NO: 551 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agaaaaatggaaatgtcgaattc

SEQ ID NO: 552 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
accaatttcagagtagagaagcc

SEQ ID NO: 553 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
atttctcaagtagagaataacga

SEQ ID NO: 554 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
atttcagttctgacactaacaag

SEQ ID NO: 555 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aagactaaaagtctagggatatg

SEQ ID NO: 556 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aaagtttcattttatggaagaga

SEQ ID NO: 557 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
agagcaatggattagaaacatta

SEQ ID NO: 558 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
acaattaatattcatgtctacct

SEQ ID NO: 559 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
aaaacaagtattttccagatcaa

SEQ ID NO: 560 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
agttttaatatttctacacagca

SEQ ID NO: 561 - RNA, 23 nt, synthetic construct
  source 1..23: mol_type = other RNA
ggaaagtggatcatatcttctct

SEQ ID NO: 562 - RNA, 23 nt, synthetic construct
  source 1..23: mol_type = other RNA
tctcaaaccaaattggaaaacat

SEQ ID NO: 563 - RNA, 23 nt, synthetic construct
  source 1..23: mol_type = other RNA
tataagtggaacatcttagagtt

SEQ ID NO: 564 - RNA, 23 nt, synthetic construct
  source 1..23: mol_type = other RNA
ttgaggacaacatcaacaagttt

SEQ ID NO: 565 - RNA, 23 nt, synthetic construct
  source 1..23: mol_type = other RNA
gagcataactactcttggattct

SEQ ID NO: 566 - RNA, 23 nt, synthetic construct
  source 1..23: mol_type = other RNA
tgttggaacttggatgttaactt

SEQ ID NO: 567 - RNA, 23 nt, synthetic construct
  source 1..23: mol_type = other RNA
aagaagaagagttcaatcttact

SEQ ID NO: 568 - RNA, 23 nt, synthetic construct
  source 1..23: mol_type = other RNA
cttcaaacacagatataattgtt

SEQ ID NO: 569 - RNA, 23 nt, synthetic construct
  source 1..23: mol_type = other RNA
caaagtaactcatctaagatttt

SEQ ID NO: 570 - RNA, 23 nt, synthetic construct
  source 1..23: mol_type = other RNA
gctatgaaataatccaagatact

SEQ ID NO: 571 - RNA, 23 nt, synthetic construct
  source 1..23: mol_type = other RNA
agactgaagaaaagccagtttct

SEQ ID NO: 572 - RNA, 23 nt, synthetic construct
  source 1..23: mol_type = other RNA
agtcattgcttcttcaagaattt

SEQ ID NO: 573 - RNA, 23 nt, synthetic construct
  source 1..23: mol_type = other RNA
cctactctcaatgatacttttct

SEQ ID NO: 574 - RNA, 23 nt, synthetic construct
  source 1..23: mol_type = other RNA
ggaaacagaagaaattattacat

SEQ ID NO: 575 - RNA, 23 nt, synthetic construct
  source 1..23: mol_type = other RNA
acagcacttttaccaaacgtgat

SEQ ID NO: 576 - RNA, 23 nt, synthetic construct
  source 1..23: mol_type = other RNA
atgagagaatttgtcttactatt

SEQ ID NO: 577 - RNA, 23 nt, synthetic construct
  source 1..23: mol_type = other RNA
aagacattcacgtggttcacttt

SEQ ID NO: 578 - RNA, 23 nt, synthetic construct
  source 1..23: mol_type = other RNA
cgctgtgttaaatgttaacagtt

SEQ ID NO: 579 - RNA, 23 nt, synthetic construct
  source 1..23: mol_type = other RNA
taacagttttccactatttctct

SEQ ID NO: 580 - RNA, 23 nt, synthetic construct
  source 1..23: mol_type = other RNA
ctctttcttttctattagtgaat

SEQ ID NO: 581 - RNA, 23 nt, synthetic construct
  source 1..23: mol_type = other RNA
actttcacaaacacatgattttt

SEQ ID NO: 582 - RNA, 23 nt, synthetic construct
  source 1..23: mol_type = other RNA
agtacttaaaatatcctgtcttt

SEQ ID NO: 583 - RNA, 23 nt, synthetic construct
  source 1..23: mol_type = other RNA
tctttcccatataacaatgattt

SEQ ID NO: 584 - RNA, 23 nt, synthetic construct
  source 1..23: mol_type = other RNA
acgtgtacatatatcaaaatgtt

SEQ ID NO: 585 - RNA, 23 nt, synthetic construct
  source 1..23: mol_type = other RNA
atcaacgaaattcataacaatct

SEQ ID NO: 586 - RNA, 23 nt, synthetic construct
  source 1..23: mol_type = other RNA
tagaaactaccagagttacctgt

SEQ ID NO: 587 - RNA, 23 nt, synthetic construct
  source 1..23: mol_type = other RNA
tcctttcttttcatgattcatgt

SEQ ID NO: 588 - RNA, 23 nt, synthetic construct
  source 1..23: mol_type = other RNA
accgcatgctaaatttaatgctt

SEQ ID NO: 589 - RNA, 23 nt, synthetic construct
  source 1..23: mol_type = other RNA
accctcttgaaatcctttatttt

SEQ ID NO: 590 - RNA, 23 nt, synthetic construct
  source 1..23: mol_type = other RNA
tctctcttgatctagaatttact

SEQ ID NO: 591 - RNA, 23 nt, synthetic construct
  source 1..23: mol_type = other RNA
gcccacaaactcaagtttgaatc

SEQ ID NO: 592 - RNA, 23 nt, synthetic construct
  source 1..23: mol_type = other RNA
gaatctttctgtaacttccttta

SEQ ID NO: 593 - RNA, 23 nt, synthetic construct
  source 1..23: mol_type = other RNA
agagtatgaaccatattttaaga

SEQ ID NO: 594 - RNA, 23 nt, synthetic construct
  source 1..23: mol_type = other RNA
atctaccatttcaggacttcttg

SEQ ID NO: 595 - RNA, 23 nt, synthetic construct
  source 1..23: mol_type = other RNA
gacatcataaaagttcactttaa

SEQ ID NO: 596 - RNA, 23 nt, synthetic construct
  source 1..23: mol_type = other RNA
cctcaaggaattaggtacagtaa

SEQ ID NO: 597 - RNA, 23 nt, synthetic construct
  source 1..23: mol_type = other RNA
cttcttaccttgaccacacattc

SEQ ID NO: 598 - RNA, 23 nt, synthetic construct
  source 1..23: mol_type = other RNA
cctcacacacatctattactccc

SEQ ID NO: 599 - RNA, 23 nt, synthetic construct
  source 1..23: mol_type = other RNA
aatctgatcgaggatttcaactc

SEQ ID NO: 600 - RNA, 23 nt, synthetic construct
  source 1..23: mol_type = other RNA
ttgacaagcaaatcgtgctacta

SEQ ID NO: 601 - RNA, 23 nt, synthetic construct
  source 1..23: mol_type = other RNA
atccctaatgtacacagtcaatg

SEQ ID NO: 602 - RNA, 23 nt, synthetic construct
  source 1..23: mol_type = other RNA
gaattattctccattcatttcaa

SEQ ID NO: 603 - RNA, 23 nt, synthetic construct
  source 1..23: mol_type = other RNA
tgcaggcttacattgacattaaa

SEQ ID NO: 604 - RNA, 23 nt, synthetic construct
  source 1..23: mol_type = other RNA
aaccaggaatcttaagaaaataa

SEQ ID NO: 605 - RNA, 23 nt, synthetic construct
  source 1..23: mol_type = other RNA
tctcagcatttggataatttctc

SEQ ID NO: 606 - RNA, 23 nt, synthetic construct
  source 1..23: mol_type = other RNA
agtacgaagatgagtccttcacc

SEQ ID NO: 607 - RNA, 23 nt, synthetic construct
  source 1..23: mol_type = other RNA
ttcaccaaacatacagtgaatcc

SEQ ID NO: 608 - RNA, 23 nt, synthetic construct
  source 1..23: mol_type = other RNA
acacactcaaaatcgtgttcaaa

SEQ ID NO: 609 - RNA, 23 nt, synthetic construct
  source 1..23: mol_type = other RNA
agatgaagtcaactcttctttca

SEQ ID NO: 610 - RNA, 23 nt, synthetic construct
  source 1..23: mol_type = other RNA
cttaacaagaccatactacagtg

SEQ ID NO: 611 - RNA, 23 nt, synthetic construct
  source 1..23: mol_type = other RNA
ctaataggactacttctaatctg

SEQ ID NO: 612 - RNA, 23 nt, synthetic construct
  source 1..23: mol_type = other RNA
tcaaacatcatgagcactatcaa

SEQ ID NO: 613 - RNA, 23 nt, synthetic construct
  source 1..23: mol_type = other RNA
ctcattcatctatggaaagaggc

SEQ ID NO: 614 - RNA, 23 nt, synthetic construct
  source 1..23: mol_type = other RNA
gttaacttccatgaattctagtc

SEQ ID NO: 615 - RNA, 23 nt, synthetic construct
  source 1..23: mol_type = other RNA
ctgactatgattaccagaacaga

SEQ ID NO: 616 - RNA, 23 nt, synthetic construct
  source 1..23: mol_type = other RNA
ttccgaaactcatcattgaatca

SEQ ID NO: 617 - RNA, 23 nt, synthetic construct
  source 1..23: mol_type = other RNA
gcactgaattcgtttcttcaaac

SEQ ID NO: 618 - RNA, 23 nt, synthetic construct
  source 1..23: mol_type = other RNA
ttgttggttcaaattattcttcc

SEQ ID NO: 619 - RNA, 23 nt, synthetic construct
  source 1..23: mol_type = other RNA
taagttcactgtcaataaccttg

SEQ ID NO: 620 - RNA, 23 nt, synthetic construct
  source 1..23: mol_type = other RNA
gaactcagttctcaattcttcca

SEQ ID NO: 621 - RNA, 23 nt, synthetic construct
  source 1..23: mol_type = other RNA
gatacgtctactttcacttggtg

SEQ ID NO: 622 - RNA, 23 nt, synthetic construct
  source 1..23: mol_type = other RNA
ctggatgaaattactagcacata

SEQ ID NO: 623 - RNA, 23 nt, synthetic construct
  source 1..23: mol_type = other RNA
ctgttactcttaaaacaaagtaa

SEQ ID NO: 624 - RNA, 23 nt, synthetic construct
  source 1..23: mol_type = other RNA
tactgatgaagacacagctgtta

SEQ ID NO: 625 - RNA, 23 nt, synthetic construct
  source 1..23: mol_type = other RNA
tcctagagttagacataaatctc

SEQ ID NO: 626 - RNA, 23 nt, synthetic construct
  source 1..23: mol_type = other RNA
atctctacaagtaagacaggatg

SEQ ID NO: 627 - RNA, 23 nt, synthetic construct
  source 1..23: mol_type = other RNA
agtttctcattaagacacgaaaa

SEQ ID NO: 628 - RNA, 23 nt, synthetic construct
  source 1..23: mol_type = other RNA
agtgaagcctacaacacattttc

SEQ ID NO: 629 - RNA, 23 nt, synthetic construct
  source 1..23: mol_type = other RNA
taaatccaatgaaacatctcttc

SEQ ID NO: 630 - RNA, 23 nt, synthetic construct
  source 1..23: mol_type = other RNA
ccataatcagaattcctcaaatg

SEQ ID NO: 631 - RNA, 23 nt, synthetic construct
  source 1..23: mol_type = other RNA
agaggaacactatcaaacattcc

SEQ ID NO: 632 - RNA, 23 nt, synthetic construct
  source 1..23: mol_type = other RNA
gatcaaatgcactctacttcaga

SEQ ID NO: 633 - RNA, 23 nt, synthetic construct
  source 1..23: mol_type = other RNA
gctcagtgaaatgcttgagtatg

SEQ ID NO: 634 - RNA, 23 nt, synthetic construct
  source 1..23: mol_type = other RNA
cttcctcagaacatgaagtctgg

SEQ ID NO: 635 - RNA, 23 nt, synthetic construct
  source 1..23: mol_type = other RNA
aactcattcagagaaacctttcc

SEQ ID NO: 636 - RNA, 23 nt, synthetic construct
  source 1..23: mol_type = other RNA
atacaaccctttctctagacttc

SEQ ID NO: 637 - RNA, 23 nt, synthetic construct
  source 1..23: mol_type = other RNA
ctctccagaactcagtcaaacaa

SEQ ID NO: 638 - RNA, 23 nt, synthetic construct
  source 1..23: mol_type = other RNA
ctttgcagatctcagtcaaattc

SEQ ID NO: 639 - RNA, 23 nt, synthetic construct
  source 1..23: mol_type = other RNA
cagaccttgatcagatattctac

SEQ ID NO: 640 - RNA, 23 nt, synthetic construct
  source 1..23: mol_type = other RNA
cttctgaatctagtcagtcattg

SEQ ID NO: 641 - RNA, 23 nt, synthetic construct
  source 1..23: mol_type = other RNA
ttctatcaaaggaatttaatcca

SEQ ID NO: 642 - RNA, 23 nt, synthetic construct
  source 1..23: mol_type = other RNA
attacattgagatcattccaaag

SEQ ID NO: 643 - RNA, 23 nt, synthetic construct
  source 1..23: mol_type = other RNA
tgactatgctgaaattgattatg

SEQ ID NO: 644 - RNA, 23 nt, synthetic construct
  source 1..23: mol_type = other RNA
gttaggacaaacatcaactcctc

SEQ ID NO: 645 - RNA, 23 nt, synthetic construct
  source 1..23: mol_type = other RNA
tctcggaattcttggtcctatta

SEQ ID NO: 646 - RNA, 23 nt, synthetic construct
  source 1..23: mol_type = other RNA
tgttatccaagttcgttttaaaa

SEQ ID NO: 647 - RNA, 23 nt, synthetic construct
  source 1..23: mol_type = other RNA
taatgctgttcagccaaatagca

SEQ ID NO: 648 - RNA, 23 nt, synthetic construct
  source 1..23: mol_type = other RNA
aatagcagttatacctacgtatg

SEQ ID NO: 649 - RNA, 23 nt, synthetic construct
  source 1..23: mol_type = other RNA
gcctggttcatttaaaactcttg

SEQ ID NO: 650 - RNA, 23 nt, synthetic construct
  source 1..23: mol_type = other RNA
gatgcaaacgccatttcttatca

SEQ ID NO: 651 - RNA, 23 nt, synthetic construct
  source 1..23: mol_type = other RNA
tcatatctgattcacagatcaag

SEQ ID NO: 652 - RNA, 23 nt, synthetic construct
  source 1..23: mol_type = other RNA
cttcagagtttctgggttactgg

SEQ ID NO: 653 - RNA, 23 nt, synthetic construct
  source 1..23: mol_type = other RNA
gcagaatttgcctctaaaccttg

SEQ ID NO: 654 - RNA, 23 nt, synthetic construct
  source 1..23: mol_type = other RNA
ctatgtagcttacagttccaacc

SEQ ID NO: 655 - RNA, 23 nt, synthetic construct
  source 1..23: mol_type = other RNA
aggaatgtgatgtattttaatgg

SEQ ID NO: 656 - RNA, 23 nt, synthetic construct
  source 1..23: mol_type = other RNA
gctagatatattaggatctctcc

SEQ ID NO: 657 - RNA, 23 nt, synthetic construct
  source 1..23: mol_type = other RNA
aatcacagcttcttcgtttaaga

SEQ ID NO: 658 - RNA, 23 nt, synthetic construct
  source 1..23: mol_type = other RNA
aaattgatctactcaagatcaag

SEQ ID NO: 659 - RNA, 23 nt, synthetic construct
  source 1..23: mol_type = other RNA
gtcctctgaaatgtatgtaaaga

SEQ ID NO: 660 - RNA, 23 nt, synthetic construct
  source 1..23: mol_type = other RNA
tgaaggaaatactaataccaaag

SEQ ID NO: 661 - RNA, 23 nt, synthetic construct
  source 1..23: mol_type = other RNA
gtcattcctaaaacatggaatca

SEQ ID NO: 662 - RNA, 23 nt, synthetic construct
  source 1..23: mol_type = other RNA
agagactctttaagacctcaaac

SEQ ID NO: 663 - RNA, 23 nt, synthetic construct
  source 1..23: mol_type = other RNA
taagataatggctattacttctg

SEQ ID NO: 664 - RNA, 23 nt, synthetic construct
  source 1..23: mol_type = other RNA
acttctgcattaatttgaataca

SEQ ID NO: 665 - RNA, 23 nt, synthetic construct
  source 1..23: mol_type = other RNA
aaaagggcttatctttcttaatg

SEQ ID NO: 666 - RNA, 23 nt, synthetic construct
  source 1..23: mol_type = other RNA
aactcttttaaatcctttacaca

SEQ ID NO: 667 - RNA, 23 nt, synthetic construct
  source 1..23: mol_type = other RNA
cacactagtaaaacagatattac

SEQ ID NO: 668 - RNA, 23 nt, synthetic construct
  source 1..23: mol_type = other RNA
tttttctgactttccatgagtaa

SEQ ID NO: 669 - RNA, 23 nt, synthetic construct
  source 1..23: mol_type = other RNA
tcaaaacataatttcacctactg

SEQ ID NO: 670 - RNA, 23 nt, synthetic construct
  source 1..23: mol_type = other RNA
tgctggtctaaatgcagttgttc

SEQ ID NO: 671 - RNA, 23 nt, synthetic construct
  source 1..23: mol_type = other RNA
tctctcttcttccagcaacttcc

SEQ ID NO: 672 - RNA, 23 nt, synthetic construct
  source 1..23: mol_type = other RNA
cctttcatcattcctttccctgg

SEQ ID NO: 673 - RNA, 23 nt, synthetic construct
  source 1..23: mol_type = other RNA
cctttagacatccttaaaatcac

SEQ ID NO: 674 - RNA, 23 nt, synthetic construct
  source 1..23: mol_type = other RNA
cttgatttaatcatcctgtaacg

SEQ ID NO: 675 - RNA, 23 nt, synthetic construct
  source 1..23: mol_type = other RNA
aggactaagaaactcactcgaaa

SEQ ID NO: 676 - RNA, 23 nt, synthetic construct
  source 1..23: mol_type = other RNA
actcgaaaccacacaactacatg

SEQ ID NO: 677 - RNA, 23 nt, synthetic construct
  source 1..23: mol_type = other RNA
agacaacataccagaatctctag

SEQ ID NO: 678 - RNA, 23 nt, synthetic construct
  source 1..23: mol_type = other RNA
ctgcattctattcgttgtgaaca

SEQ ID NO: 679 - RNA, 23 nt, synthetic construct
  source 1..23: mol_type = other RNA
cagtctcgattcagtgtagaagg

SEQ ID NO: 680 - RNA, 23 nt, synthetic construct
  source 1..23: mol_type = other RNA
acatccacaaaacattggctttc

SEQ ID NO: 681 - RNA, 23 nt, synthetic construct
  source 1..23: mol_type = other RNA
ttcgtattcccactattcctttc

SEQ ID NO: 682 - RNA, 23 nt, synthetic construct
  source 1..23: mol_type = other RNA
cccatcaacatttctaagatttc

SEQ ID NO: 683 - RNA, 23 nt, synthetic construct
  source 1..23: mol_type = other RNA
ggaaaacatttctttgttttcta

SEQ ID NO: 684 - RNA, 23 nt, synthetic construct
  source 1..23: mol_type = other RNA
gtgtgatctgttcagttgcaaag

SEQ ID NO: 685 - RNA, 23 nt, synthetic construct
  source 1..23: mol_type = other RNA
gaattcgacatttccatttttca

SEQ ID NO: 686 - RNA, 23 nt, synthetic construct
  source 1..23: mol_type = other RNA
ggcttctctactctgaaattggg

SEQ ID NO: 687 - RNA, 23 nt, synthetic construct
  source 1..23: mol_type = other RNA
tcgttattctctacttgagaaaa

SEQ ID NO: 688 - RNA, 23 nt, synthetic construct
  source 1..23: mol_type = other RNA
cttgttagtgtcagaactgaaac

SEQ ID NO: 689 - RNA, 23 nt, synthetic construct
  source 1..23: mol_type = other RNA
catatccctagacttttagtctg

SEQ ID NO: 690 - RNA, 23 nt, synthetic construct
  source 1..23: mol_type = other RNA
tctcttccataaaatgaaactta

SEQ ID NO: 691 - RNA, 23 nt, synthetic construct
  source 1..23: mol_type = other RNA
taatgtttctaatccattgctca

SEQ ID NO: 692 - RNA, 23 nt, synthetic construct
  source 1..23: mol_type = other RNA
aggtagacatgaatattaattga

SEQ ID NO: 693 - RNA, 23 nt, synthetic construct
  source 1..23: mol_type = other RNA
ttgatctggaaaatacttgtttg

SEQ ID NO: 694 - RNA, 23 nt, synthetic construct
  source 1..23: mol_type = other RNA
tgctgtgtagaaatattaaaacc

SEQ ID NO: 695 - RNA, 21 nt, synthetic construct
  source 1..21: mol_type = other RNA
cagctaaggcagttctacgtt

SEQ ID NO: 696 - RNA, 21 nt, synthetic construct
  source 1..21: mol_type = other RNA
agggcatcagttggagctact

SEQ ID NO: 697 - RNA, 21 nt, synthetic construct
  source 1..21: mol_type = other RNA
tctacagagagtatgaaccat

SEQ ID NO: 698 - RNA, 21 nt, synthetic construct
  source 1..21: mol_type = other RNA
tacagagagtatgaaccatat

SEQ ID NO: 699 - RNA, 21 nt, synthetic construct
  source 1..21: mol_type = other RNA
acagagagtatgaaccatatt

SEQ ID NO: 700 - RNA, 21 nt, synthetic construct
  source 1..21: mol_type = other RNA
ttcttgggcctactttatatt

SEQ ID NO: 701 - RNA, 21 nt, synthetic construct
  source 1..21: mol_type = other RNA
tactttatatgctgaagtcgt

SEQ ID NO: 702 - RNA, 21 nt, synthetic construct
  source 1..21: mol_type = other RNA
actttatatgctgaagtcggt

SEQ ID NO: 703 - RNA, 21 nt, synthetic construct
  source 1..21: mol_type = other RNA
agtaaattatcagaaggtgct

SEQ ID NO: 704 - RNA, 21 nt, synthetic construct
  source 1..21: mol_type = other RNA
aaattatcagaaggtgcttct

SEQ ID NO: 705 - RNA, 21 nt, synthetic construct
  source 1..21: mol_type = other RNA
atcagaaggtgcttcttacct

SEQ ID NO: 706 - RNA, 21 nt, synthetic construct
  source 1..21: mol_type = other RNA
tcagaaggtgcttcttacctt

SEQ ID NO: 707 - RNA, 21 nt, synthetic construct
  source 1..21: mol_type = other RNA
cagaaggtgcttcttaccttt

SEQ ID NO: 708 - RNA, 21 nt, synthetic construct
  source 1..21: mol_type = other RNA
atacacctatgaatggagtat

SEQ ID NO: 709 - RNA, 21 nt, synthetic construct
  source 1..21: mol_type = other RNA
acctatgaatggagtatcagt

SEQ ID NO: 710 - RNA, 21 nt, synthetic construct
  source 1..21: mol_type = other RNA
cctatgaatggagtatcagtt

SEQ ID NO: 711 - RNA, 21 nt, synthetic construct
  source 1..21: mol_type = other RNA
atgaatggagtatcagtgagt

SEQ ID NO: 712 - RNA, 21 nt, synthetic construct
  source 1..21: mol_type = other RNA
atgcctcacacacatctattt

SEQ ID NO: 713 - RNA, 21 nt, synthetic construct
  source 1..21: mol_type = other RNA
tgcctcacacacatctattat

SEQ ID NO: 714 - RNA, 21 nt, synthetic construct
  source 1..21: mol_type = other RNA
cctcacacacatctattactt

SEQ ID NO: 715 - RNA, 21 nt, synthetic construct
  source 1..21: mol_type = other RNA
cacacacatctattactccct

SEQ ID NO: 716 - RNA, 21 nt, synthetic construct
  source 1..21: mol_type = other RNA
acatctattactcccatgaat

SEQ ID NO: 717 - RNA, 21 nt, synthetic construct
  source 1..21: mol_type = other RNA
gaagacgtttgacaagcaaat

SEQ ID NO: 718 - RNA, 21 nt, synthetic construct
  source 1..21: mol_type = other RNA
agacgtttgacaagcaaatct

SEQ ID NO: 719 - RNA, 21 nt, synthetic construct
  source 1..21: mol_type = other RNA
gacgtttgacaagcaaatcgt

SEQ ID NO: 720 - RNA, 21 nt, synthetic construct
  source 1..21: mol_type = other RNA
gccagtcatcatccctaatgt

SEQ ID NO: 721 - RNA, 21 nt, synthetic construct
  source 1..21: mol_type = other RNA
gtcatcatccctaatgtacat

SEQ ID NO: 722 - RNA, 21 nt, synthetic construct
  source 1..21: mol_type = other RNA
catcatccctaatgtacacat

SEQ ID NO: 723 - RNA, 21 nt, synthetic construct
  source 1..21: mol_type = other RNA
atcatccctaatgtacacagt

SEQ ID NO: 724 - RNA, 21 nt, synthetic construct
  source 1..21: mol_type = other RNA
aatgtacacagtcaatggatt

SEQ ID NO: 725 - RNA, 21 nt, synthetic construct
  source 1..21: mol_type = other RNA
atgtacacagtcaatggatat

SEQ ID NO: 726 - RNA, 21 nt, synthetic construct
  source 1..21: mol_type = other RNA
atgtgaatgggacaatgccat

SEQ ID NO: 727 - RNA, 21 nt, synthetic construct
  source 1..21: mol_type = other RNA
gccagatataacagtttgtgt

SEQ ID NO: 728 - RNA, 21 nt, synthetic construct
  source 1..21: mol_type = other RNA
ccagatataacagtttgtgct

SEQ ID NO: 729 - RNA, 21 nt, synthetic construct
  source 1..21: mol_type = other RNA
gagcagaaccatcataaggtt

SEQ ID NO: 730 - RNA, 21 nt, synthetic construct
  source 1..21: mol_type = other RNA
cagaaccatcataaggtctct

SEQ ID NO: 731 - RNA, 21 nt, synthetic construct
  source 1..21: mol_type = other RNA
agaaccatcataaggtctcat

SEQ ID NO: 732 - RNA, 21 nt, synthetic construct
  source 1..21: mol_type = other RNA
atcacccttgtcagtgctact

SEQ ID NO: 733 - RNA, 21 nt, synthetic construct
  source 1..21: mol_type = other RNA
ttgtcagtgctacatccactt

SEQ ID NO: 734 - RNA, 21 nt, synthetic construct
  source 1..21: mol_type = other RNA
catccactaccgcaaatatgt

SEQ ID NO: 735 - RNA, 21 nt, synthetic construct
  source 1..21: mol_type = other RNA
aagctgggatgcaggcttact

SEQ ID NO: 736 - RNA, 21 nt, synthetic construct
  source 1..21: mol_type = other RNA
agctgggatgcaggcttacat

SEQ ID NO: 737 - RNA, 21 nt, synthetic construct
  source 1..21: mol_type = other RNA
gctgggatgcaggcttacatt

SEQ ID NO: 738 - RNA, 21 nt, synthetic construct
  source 1..21: mol_type = other RNA
ctgggatgcaggcttacattt

SEQ ID NO: 739 - RNA, 21 nt, synthetic construct
  source 1..21: mol_type = other RNA
tgggatgcaggcttacattgt

SEQ ID NO: 740 - RNA, 21 nt, synthetic construct
  source 1..21: mol_type = other RNA
gggatgcaggcttacattgat

SEQ ID NO: 741 - RNA, 21 nt, synthetic construct
  source 1..21: mol_type = other RNA
ggatgcaggcttacattgact

SEQ ID NO: 742 - RNA, 21 nt, synthetic construct
  source 1..21: mol_type = other RNA
gatgcaggcttacattgacat

SEQ ID NO: 743 - RNA, 21 nt, synthetic construct
  source 1..21: mol_type = other RNA
atgcaggcttacattgacatt

SEQ ID NO: 744 - RNA, 21 nt, synthetic construct
  source 1..21: mol_type = other RNA
tgcaggcttacattgacattt

SEQ ID NO: 745 - RNA, 21 nt, synthetic construct
  source 1..21: mol_type = other RNA
gcaggcttacattgacattat

SEQ ID NO: 746 - RNA, 21 nt, synthetic construct
  source 1..21: mol_type = other RNA
aggcttacattgacattaaat

SEQ ID NO: 747 - RNA, 21 nt, synthetic construct
  source 1..21: mol_type = other RNA
ggcttacattgacattaaaat

SEQ ID NO: 748 - RNA, 21 nt, synthetic construct
  source 1..21: mol_type = other RNA
gcttacattgacattaaaaat

SEQ ID NO: 749 - RNA, 21 nt, synthetic construct
  source 1..21: mol_type = other RNA
cttacattgacattaaaaact

SEQ ID NO: 750 - RNA, 21 nt, synthetic construct
  source 1..21: mol_type = other RNA
ttacattgacattaaaaactt

SEQ ID NO: 751 - RNA, 21 nt, synthetic construct
  source 1..21: mol_type = other RNA
tacattgacattaaaaactgt

SEQ ID NO: 752 - RNA, 21 nt, synthetic construct
  source 1..21: mol_type = other RNA
acattgacattaaaaactgct

SEQ ID NO: 753 - RNA, 21 nt, synthetic construct
  source 1..21: mol_type = other RNA
cattgacattaaaaactgcct

SEQ ID NO: 754 - RNA, 21 nt, synthetic construct
  source 1..21: mol_type = other RNA
attgacattaaaaactgccct

SEQ ID NO: 755 - RNA, 21 nt, synthetic construct
  source 1..21: mol_type = other RNA
ttgacattaaaaactgcccat

SEQ ID NO: 756 - RNA, 21 nt, synthetic construct
  source 1..21: mol_type = other RNA
gggaatacttcattgctgcat

SEQ ID NO: 757 - RNA, 21 nt, synthetic construct
  source 1..21: mol_type = other RNA
agtcatttgggactatgcact

SEQ ID NO: 758 - RNA, 21 nt, synthetic construct
  source 1..21: mol_type = other RNA
gggactatgcacctgtaatat

SEQ ID NO: 759 - RNA, 21 nt, synthetic construct
  source 1..21: mol_type = other RNA
cacctgtaataccagcgaatt

SEQ ID NO: 760 - RNA, 21 nt, synthetic construct
  source 1..21: mol_type = other RNA
tgtaataccagcgaatatggt

SEQ ID NO: 761 - RNA, 21 nt, synthetic construct
  source 1..21: mol_type = other RNA
gtaataccagcgaatatggat

SEQ ID NO: 762 - RNA, 21 nt, synthetic construct
  source 1..21: mol_type = other RNA
aggtctcagcatttggataat

SEQ ID NO: 763 - RNA, 21 nt, synthetic construct
  source 1..21: mol_type = other RNA
gttatgtacacacagtacgat

SEQ ID NO: 764 - RNA, 21 nt, synthetic construct
  source 1..21: mol_type = other RNA
ttatgtacacacagtacgaat

SEQ ID NO: 765 - RNA, 21 nt, synthetic construct
  source 1..21: mol_type = other RNA
atgtacacacagtacgaagat

SEQ ID NO: 766 - RNA, 21 nt, synthetic construct
  source 1..21: mol_type = other RNA
tgtacacacagtacgaagatt

SEQ ID NO: 767 - RNA, 21 nt, synthetic construct
  source 1..21: mol_type = other RNA
gtacacacagtacgaagatgt

SEQ ID NO: 768 - RNA, 21 nt, synthetic construct
  source 1..21: mol_type = other RNA
agtacgaagatgagtccttct

SEQ ID NO: 769 - RNA, 21 nt, synthetic construct
  source 1..21: mol_type = other RNA
gtacgaagatgagtccttcat

SEQ ID NO: 770 - RNA, 21 nt, synthetic construct
  source 1..21: mol_type = other RNA
gtgaatcccaatatgaaagat

SEQ ID NO: 771 - RNA, 21 nt, synthetic construct
  source 1..21: mol_type = other RNA
accctcatggagtgaccttct

SEQ ID NO: 772 - RNA, 21 nt, synthetic construct
  source 1..21: mol_type = other RNA
gaacaacaccatgatcagagt

SEQ ID NO: 773 - RNA, 21 nt, synthetic construct
  source 1..21: mol_type = other RNA
caacaccatgatcagagcagt

SEQ ID NO: 774 - RNA, 21 nt, synthetic construct
  source 1..21: mol_type = other RNA
caccatgatcagagcagttct

SEQ ID NO: 775 - RNA, 21 nt, synthetic construct
  source 1..21: mol_type = other RNA
catgatcagagcagttcaact

SEQ ID NO: 776 - RNA, 21 nt, synthetic construct
  source 1..21: mol_type = other RNA
tgatcagagcagttcaaccat

SEQ ID NO: 777 - RNA, 21 nt, synthetic construct
  source 1..21: mol_type = other RNA
aaacctatacttataagtggt

SEQ ID NO: 778 - RNA, 21 nt, synthetic construct
  source 1..21: mol_type = other RNA
aacctatacttataagtggat

SEQ ID NO: 779 - RNA, 21 nt, synthetic construct
  source 1..21: mol_type = other RNA
cttataagtggaacatcttat

SEQ ID NO: 780 - RNA, 21 nt, synthetic construct
  source 1..21: mol_type = other RNA
tctaatctgtaagagcagatt

SEQ ID NO: 781 - RNA, 21 nt, synthetic construct
  source 1..21: mol_type = other RNA
aatctgtaagagcagatccct

SEQ ID NO: 782 - RNA, 21 nt, synthetic construct
  source 1..21: mol_type = other RNA
accttgaggacaacatcaact

SEQ ID NO: 783 - RNA, 21 nt, synthetic construct
  source 1..21: mol_type = other RNA
atgaatcaaacatcatgagct

SEQ ID NO: 784 - RNA, 21 nt, synthetic construct
  source 1..21: mol_type = other RNA
gaatcaaacatcatgagcact

SEQ ID NO: 785 - RNA, 21 nt, synthetic construct
  source 1..21: mol_type = other RNA
tgagcactatcaatggctatt

SEQ ID NO: 786 - RNA, 21 nt, synthetic construct
  source 1..21: mol_type = other RNA
gattctgctttgatgacactt

SEQ ID NO: 787 - RNA, 21 nt, synthetic construct
  source 1..21: mol_type = other RNA
ccagtggcacttctgtagtgt

SEQ ID NO: 788 - RNA, 21 nt, synthetic construct
  source 1..21: mol_type = other RNA
agtggcacttctgtagtgtgt

SEQ ID NO: 789 - RNA, 21 nt, synthetic construct
  source 1..21: mol_type = other RNA
ctgggcactcattcatctatt

SEQ ID NO: 790 - RNA, 21 nt, synthetic construct
  source 1..21: mol_type = other RNA
gtgacggtcacaatggataat

SEQ ID NO: 791 - RNA, 21 nt, synthetic construct
  source 1..21: mol_type = other RNA
ggaacttggatgttaacttct

SEQ ID NO: 792 - RNA, 21 nt, synthetic construct
  source 1..21: mol_type = other RNA
ttaacttccatgaattctagt

SEQ ID NO: 793 - RNA, 21 nt, synthetic construct
  source 1..21: mol_type = other RNA
atgatgatgaagactcatatt

SEQ ID NO: 794 - RNA, 21 nt, synthetic construct
  source 1..21: mol_type = other RNA
tgatgaagactcatatgagat

SEQ ID NO: 795 - RNA, 21 nt, synthetic construct
  source 1..21: mol_type = other RNA
aaactcatcattgaatcaggt

SEQ ID NO: 796 - RNA, 21 nt, synthetic construct
  source 1..21: mol_type = other RNA
aaacacagatataattgttgt

SEQ ID NO: 797 - RNA, 21 nt, synthetic construct
  source 1..21: mol_type = other RNA
cacagatataattgttggttt

SEQ ID NO: 798 - RNA, 21 nt, synthetic construct
  source 1..21: mol_type = other RNA
catattctgaagaccctatat

SEQ ID NO: 799 - RNA, 21 nt, synthetic construct
  source 1..21: mol_type = other RNA
attctgaagaccctatagagt

SEQ ID NO: 800 - RNA, 21 nt, synthetic construct
  source 1..21: mol_type = other RNA
cgtctactttcacttggtgct

SEQ ID NO: 801 - RNA, 21 nt, synthetic construct
  source 1..21: mol_type = other RNA
atgaaattactagcacataat

SEQ ID NO: 802 - RNA, 21 nt, synthetic construct
  source 1..21: mol_type = other RNA
aattactagcacataaagttt

SEQ ID NO: 803 - RNA, 21 nt, synthetic construct
  source 1..21: mol_type = other RNA
tactagcacataaagttgggt

SEQ ID NO: 804 - RNA, 21 nt, synthetic construct
  source 1..21: mol_type = other RNA
gagatggcatttggcttctgt

SEQ ID NO: 805 - RNA, 21 nt, synthetic construct
  source 1..21: mol_type = other RNA
gtagctatgaaataatccaat

SEQ ID NO: 806 - RNA, 21 nt, synthetic construct
  source 1..21: mol_type = other RNA
caagatactgatgaagacact

SEQ ID NO: 807 - RNA, 21 nt, synthetic construct
  source 1..21: mol_type = other RNA
gatactgatgaagacacagct

SEQ ID NO: 808 - RNA, 21 nt, synthetic construct
  source 1..21: mol_type = other RNA
aagacacagctgttaacaatt

SEQ ID NO: 809 - RNA, 21 nt, synthetic construct
  source 1..21: mol_type = other RNA
aagtttcctagagttagacat

SEQ ID NO: 810 - RNA, 21 nt, synthetic construct
  source 1..21: mol_type = other RNA
cctagagttagacataaatct

SEQ ID NO: 811 - RNA, 21 nt, synthetic construct
  source 1..21: mol_type = other RNA
tacaagtaagacaggatggat

SEQ ID NO: 812 - RNA, 21 nt, synthetic construct
  source 1..21: mol_type = other RNA
gtttctcattaagacacgaat

SEQ ID NO: 813 - RNA, 21 nt, synthetic construct
  source 1..21: mol_type = other RNA
caccatgctcctttatctcct

SEQ ID NO: 814 - RNA, 21 nt, synthetic construct
  source 1..21: mol_type = other RNA
aggacctttcaccctctaagt

SEQ ID NO: 815 - RNA, 21 nt, synthetic construct
  source 1..21: mol_type = other RNA
gtgcttcataaatccaatgat

SEQ ID NO: 816 - RNA, 21 nt, synthetic construct
  source 1..21: mol_type = other RNA
tgcttcataaatccaatgaat

SEQ ID NO: 817 - RNA, 21 nt, synthetic construct
  source 1..21: mol_type = other RNA
ccaatgaaacatctcttccct

SEQ ID NO: 818 - RNA, 21 nt, synthetic construct
  source 1..21: mol_type = other RNA
acttcctgaccataatcagat

SEQ ID NO: 819 - RNA, 21 nt, synthetic construct
  source 1..21: mol_type = other RNA
aaatgcttgagtatgaccgat

SEQ ID NO: 820 - RNA, 21 nt, synthetic construct
  source 1..21: mol_type = other RNA
gcttgagtatgaccgaagtct

SEQ ID NO: 821 - RNA, 21 nt, synthetic construct
  source 1..21: mol_type = other RNA
gagtatgaccgaagtcacaat

SEQ ID NO: 822 - RNA, 21 nt, synthetic construct
  source 1..21: mol_type = other RNA
tatgaccgaagtcacaagtct

SEQ ID NO: 823 - RNA, 21 nt, synthetic construct
  source 1..21: mol_type = other RNA
tgaccgaagtcacaagtcctt

SEQ ID NO: 824 - RNA, 21 nt, synthetic construct
  source 1..21: mol_type = other RNA
gaccgaagtcacaagtccttt

SEQ ID NO: 825 - RNA, 21 nt, synthetic construct
  source 1..21: mol_type = other RNA
accgaagtcacaagtccttct

SEQ ID NO: 826 - RNA, 21 nt, synthetic construct
  source 1..21: mol_type = other RNA
tctccagaactcagtcagact

SEQ ID NO: 827 - RNA, 21 nt, synthetic construct
  source 1..21: mol_type = other RNA
ctccagaactcagtcagacat

SEQ ID NO: 828 - RNA, 21 nt, synthetic construct
  source 1..21: mol_type = other RNA
cagccagacaaacctctctct

SEQ ID NO: 829 - RNA, 21 nt, synthetic construct
  source 1..21: mol_type = other RNA
ttctacccttctgaatctagt

SEQ ID NO: 830 - RNA, 21 nt, synthetic construct
  source 1..21: mol_type = other RNA
catctcctactctcaatgatt

SEQ ID NO: 831 - RNA, 21 nt, synthetic construct
  source 1..21: mol_type = other RNA
atcaaaggaatttaatccact

SEQ ID NO: 832 - RNA, 21 nt, synthetic construct
  source 1..21: mol_type = other RNA
aaggaatttaatccactggtt

SEQ ID NO: 833 - RNA, 21 nt, synthetic construct
  source 1..21: mol_type = other RNA
tttaatccactggttatagtt

SEQ ID NO: 834 - RNA, 21 nt, synthetic construct
  source 1..21: mol_type = other RNA
ttaatccactggttatagtgt

SEQ ID NO: 835 - RNA, 21 nt, synthetic construct
  source 1..21: mol_type = other RNA
agatggtacagattacattgt

SEQ ID NO: 836 - RNA, 21 nt, synthetic construct
  source 1..21: mol_type = other RNA
atggtacagattacattgagt

SEQ ID NO: 837 - RNA, 21 nt, synthetic construct
  source 1..21: mol_type = other RNA
actgatgttaggacaaacatt

SEQ ID NO: 838 - RNA, 21 nt, synthetic construct
  source 1..21: mol_type = other RNA
ctgatgttaggacaaacatct

SEQ ID NO: 839 - RNA, 21 nt, synthetic construct
  source 1..21: mol_type = other RNA
gaagaaatatcctgggattat

SEQ ID NO: 840 - RNA, 21 nt, synthetic construct
  source 1..21: mol_type = other RNA
tgaagactctgatgatattct

SEQ ID NO: 841 - RNA, 21 nt, synthetic construct
  source 1..21: mol_type = other RNA
gtatgaagagcatctcggaat

SEQ ID NO: 842 - RNA, 21 nt, synthetic construct
  source 1..21: mol_type = other RNA
agagcatctcggaattcttgt

SEQ ID NO: 843 - RNA, 21 nt, synthetic construct
  source 1..21: mol_type = other RNA
cggaattcttggtcctattat

SEQ ID NO: 844 - RNA, 21 nt, synthetic construct
  source 1..21: mol_type = other RNA
aattcttggtcctattatcat

SEQ ID NO: 845 - RNA, 21 nt, synthetic construct
  source 1..21: mol_type = other RNA
tcttggtcctattatcagagt

SEQ ID NO: 846 - RNA, 21 nt, synthetic construct
  source 1..21: mol_type = other RNA
gtcctattatcagagctgaat

SEQ ID NO: 847 - RNA, 21 nt, synthetic construct
  source 1..21: mol_type = other RNA
tgaagtggatgatgttatcct

SEQ ID NO: 848 - RNA, 21 nt, synthetic construct
  source 1..21: mol_type = other RNA
gaagtggatgatgttatccat

SEQ ID NO: 849 - RNA, 21 nt, synthetic construct
  source 1..21: mol_type = other RNA
atcagagggaaagacttatgt

SEQ ID NO: 850 - RNA, 21 nt, synthetic construct
  source 1..21: mol_type = other RNA
agggaaagacttatgaagatt

SEQ ID NO: 851 - RNA, 21 nt, synthetic construct
  source 1..21: mol_type = other RNA
agccaaatagcagttatacct

SEQ ID NO: 852 - RNA, 21 nt, synthetic construct
  source 1..21: mol_type = other RNA
agcagttatacctacgtatgt

SEQ ID NO: 853 - RNA, 21 nt, synthetic construct
  source 1..21: mol_type = other RNA
gatattcactcaggcttgatt

SEQ ID NO: 854 - RNA, 21 nt, synthetic construct
  source 1..21: mol_type = other RNA
ggaatactacataaggacagt

SEQ ID NO: 855 - RNA, 21 nt, synthetic construct
  source 1..21: mol_type = other RNA
ctacataaggacagcaacatt

SEQ ID NO: 856 - RNA, 21 nt, synthetic construct
  source 1..21: mol_type = other RNA
acataaggacagcaacatgct

SEQ ID NO: 857 - RNA, 21 nt, synthetic construct
  source 1..21: mol_type = other RNA
acatgagagaatttgtcttat

SEQ ID NO: 858 - RNA, 21 nt, synthetic construct
  source 1..21: mol_type = other RNA
catgagagaatttgtcttact

SEQ ID NO: 859 - RNA, 21 nt, synthetic construct
  source 1..21: mol_type = other RNA
gacctttgatgaaaagaagat

SEQ ID NO: 860 - RNA, 21 nt, synthetic construct
  source 1..21: mol_type = other RNA
acctttgatgaaaagaagagt

SEQ ID NO: 861 - RNA, 21 nt, synthetic construct
  source 1..21: mol_type = other RNA
cctttgatgaaaagaagagct

SEQ ID NO: 862 - RNA, 21 nt, synthetic construct
  source 1..21: mol_type = other RNA
ctttgatgaaaagaagagctt

SEQ ID NO: 863 - RNA, 21 nt, synthetic construct
  source 1..21: mol_type = other RNA
tttgatgaaaagaagagctgt

SEQ ID NO: 864 - RNA, 21 nt, synthetic construct
  source 1..21: mol_type = other RNA
ttgatgaaaagaagagctggt

SEQ ID NO: 865 - RNA, 21 nt, synthetic construct
  source 1..21: mol_type = other RNA
tgatgaaaagaagagctggtt

SEQ ID NO: 866 - RNA, 21 nt, synthetic construct
  source 1..21: mol_type = other RNA
gatgaaaagaagagctggtat

SEQ ID NO: 867 - RNA, 21 nt, synthetic construct
  source 1..21: mol_type = other RNA
atgaaaagaagagctggtact

SEQ ID NO: 868 - RNA, 21 nt, synthetic construct
  source 1..21: mol_type = other RNA
tgaaaagaagagctggtactt

SEQ ID NO: 869 - RNA, 21 nt, synthetic construct
  source 1..21: mol_type = other RNA
gaaaagaagagctggtactat

SEQ ID NO: 870 - RNA, 21 nt, synthetic construct
  source 1..21: mol_type = other RNA
aaaagaagagctggtactatt

SEQ ID NO: 871 - RNA, 21 nt, synthetic construct
  source 1..21: mol_type = other RNA
aaagaagagctggtactatgt

SEQ ID NO: 872 - RNA, 21 nt, synthetic construct
  source 1..21: mol_type = other RNA
aagaagagctggtactatgat

SEQ ID NO: 873 - RNA, 21 nt, synthetic construct
  source 1..21: mol_type = other RNA
agaagagctggtactatgaat

SEQ ID NO: 874 - RNA, 21 nt, synthetic construct
  source 1..21: mol_type = other RNA
gaagagctggtactatgaaat

SEQ ID NO: 875 - RNA, 21 nt, synthetic construct
  source 1..21: mol_type = other RNA
aagagctggtactatgaaaat

SEQ ID NO: 876 - RNA, 21 nt, synthetic construct
  source 1..21: mol_type = other RNA
agagctggtactatgaaaagt

SEQ ID NO: 877 - RNA, 21 nt, synthetic construct
  source 1..21: mol_type = other RNA
gagctggtactatgaaaagat

SEQ ID NO: 878 - RNA, 21 nt, synthetic construct
  source 1..21: mol_type = other RNA
agctggtactatgaaaagaat

SEQ ID NO: 879 - RNA, 21 nt, synthetic construct
  source 1..21: mol_type = other RNA
gctggtactatgaaaagaagt

SEQ ID NO: 880 - RNA, 21 nt, synthetic construct
  source 1..21: mol_type = other RNA
ctggtactatgaaaagaagtt

SEQ ID NO: 881 - RNA, 21 nt, synthetic construct
  source 1..21: mol_type = other RNA
ccgaagttcttggagactcat

SEQ ID NO: 882 - RNA, 21 nt, synthetic construct
  source 1..21: mol_type = other RNA
gaagttcttggagactcacat

SEQ ID NO: 883 - RNA, 21 nt, synthetic construct
  source 1..21: mol_type = other RNA
tttcacgccattaatgggatt

SEQ ID NO: 884 - RNA, 21 nt, synthetic construct
  source 1..21: mol_type = other RNA
attaatgggatgatctacagt

SEQ ID NO: 885 - RNA, 21 nt, synthetic construct
  source 1..21: mol_type = other RNA
gctcccaagacattcacgtgt

SEQ ID NO: 886 - RNA, 21 nt, synthetic construct
  source 1..21: mol_type = other RNA
ccaagacattcacgtggttct

SEQ ID NO: 887 - RNA, 21 nt, synthetic construct
  source 1..21: mol_type = other RNA
attcacgtggttcactttcat

SEQ ID NO: 888 - RNA, 21 nt, synthetic construct
  source 1..21: mol_type = other RNA
atgcaaacgccatttcttatt

SEQ ID NO: 889 - RNA, 21 nt, synthetic construct
  source 1..21: mol_type = other RNA
gcaaacgccatttcttatcat

SEQ ID NO: 890 - RNA, 21 nt, synthetic construct
  source 1..21: mol_type = other RNA
tcttatcatggacagagactt

SEQ ID NO: 891 - RNA, 21 nt, synthetic construct
  source 1..21: mol_type = other RNA
ttatcatggacagagactgtt

SEQ ID NO: 892 - RNA, 21 nt, synthetic construct
  source 1..21: mol_type = other RNA
taagcactggtatcatatctt

SEQ ID NO: 893 - RNA, 21 nt, synthetic construct
  source 1..21: mol_type = other RNA
tcatatctgattcacagatct

SEQ ID NO: 894 - RNA, 21 nt, synthetic construct
  source 1..21: mol_type = other RNA
taaacaatggtggatcttatt

SEQ ID NO: 895 - RNA, 21 nt, synthetic construct
  source 1..21: mol_type = other RNA
aaacaatggtggatcttatat

SEQ ID NO: 896 - RNA, 21 nt, synthetic construct
  source 1..21: mol_type = other RNA
caatggtggatcttataatgt

SEQ ID NO: 897 - RNA, 21 nt, synthetic construct
  source 1..21: mol_type = other RNA
ggtggatcttataatgcttgt

SEQ ID NO: 898 - RNA, 21 nt, synthetic construct
  source 1..21: mol_type = other RNA
atcttataatgcttggagtgt

SEQ ID NO: 899 - RNA, 21 nt, synthetic construct
  source 1..21: mol_type = other RNA
caaggtgccaaacactacctt

SEQ ID NO: 900 - RNA, 21 nt, synthetic construct
  source 1..21: mol_type = other RNA
cctgctataccacagagttct

SEQ ID NO: 901 - RNA, 21 nt, synthetic construct
  source 1..21: mol_type = other RNA
tataccacagagttctatgtt

SEQ ID NO: 902 - RNA, 21 nt, synthetic construct
  source 1..21: mol_type = other RNA
taccacagagttctatgtagt

SEQ ID NO: 903 - RNA, 21 nt, synthetic construct
  source 1..21: mol_type = other RNA
ccacagagttctatgtagctt

SEQ ID NO: 904 - RNA, 21 nt, synthetic construct
  source 1..21: mol_type = other RNA
cacagagttctatgtagcttt

SEQ ID NO: 905 - RNA, 21 nt, synthetic construct
  source 1..21: mol_type = other RNA
agagttctatgtagcttacat

SEQ ID NO: 906 - RNA, 21 nt, synthetic construct
  source 1..21: mol_type = other RNA
agttctatgtagcttacagtt

SEQ ID NO: 907 - RNA, 21 nt, synthetic construct
  source 1..21: mol_type = other RNA
tctatgtagcttacagttcct

SEQ ID NO: 908 - RNA, 21 nt, synthetic construct
  source 1..21: mol_type = other RNA
caattcagatgcctctacaat

SEQ ID NO: 909 - RNA, 21 nt, synthetic construct
  source 1..21: mol_type = other RNA
aattcagatgcctctacaatt

SEQ ID NO: 910 - RNA, 21 nt, synthetic construct
  source 1..21: mol_type = other RNA
ttcagatgcctctacaataat

SEQ ID NO: 911 - RNA, 21 nt, synthetic construct
  source 1..21: mol_type = other RNA
atcagtttgacccacctattt

SEQ ID NO: 912 - RNA, 21 nt, synthetic construct
  source 1..21: mol_type = other RNA
tcagtttgacccacctattgt

SEQ ID NO: 913 - RNA, 21 nt, synthetic construct
  source 1..21: mol_type = other RNA
cagtttgacccacctattgtt

SEQ ID NO: 914 - RNA, 21 nt, synthetic construct
  source 1..21: mol_type = other RNA
ctattgtggctagatatattt

SEQ ID NO: 915 - RNA, 21 nt, synthetic construct
  source 1..21: mol_type = other RNA
ggctagatatattaggatctt

SEQ ID NO: 916 - RNA, 21 nt, synthetic construct
  source 1..21: mol_type = other RNA
gatatattaggatctctccat

SEQ ID NO: 917 - RNA, 21 nt, synthetic construct
  source 1..21: mol_type = other RNA
agcaaatcacagcttcttcgt

SEQ ID NO: 918 - RNA, 21 nt, synthetic construct
  source 1..21: mol_type = other RNA
agtggctagaaattgatctat

SEQ ID NO: 919 - RNA, 21 nt, synthetic construct
  source 1..21: mol_type = other RNA
aaattgatctactcaagatct

SEQ ID NO: 920 - RNA, 21 nt, synthetic construct
  source 1..21: mol_type = other RNA
aaatgtatgtaaagagctatt

SEQ ID NO: 921 - RNA, 21 nt, synthetic construct
  source 1..21: mol_type = other RNA
atgtaaagagctataccatct

SEQ ID NO: 922 - RNA, 21 nt, synthetic construct
  source 1..21: mol_type = other RNA
aagagctataccatccactat

SEQ ID NO: 923 - RNA, 21 nt, synthetic construct
  source 1..21: mol_type = other RNA
ctccatggtggacaagatttt

SEQ ID NO: 924 - RNA, 21 nt, synthetic construct
  source 1..21: mol_type = other RNA
tccatggtggacaagattttt

SEQ ID NO: 925 - RNA, 21 nt, synthetic construct
  source 1..21: mol_type = other RNA
ccatggtggacaagatttttt

SEQ ID NO: 926 - RNA, 21 nt, synthetic construct
  source 1..21: mol_type = other RNA
catggtggacaagatttttgt

SEQ ID NO: 927 - RNA, 21 nt, synthetic construct
  source 1..21: mol_type = other RNA
atggtggacaagatttttgat

SEQ ID NO: 928 - RNA, 21 nt, synthetic construct
  source 1..21: mol_type = other RNA
tggtggacaagatttttgaat

SEQ ID NO: 929 - RNA, 21 nt, synthetic construct
  source 1..21: mol_type = other RNA
ggtggacaagatttttgaagt

SEQ ID NO: 930 - RNA, 21 nt, synthetic construct
  source 1..21: mol_type = other RNA
gtggacaagatttttgaaggt

SEQ ID NO: 931 - RNA, 21 nt, synthetic construct
  source 1..21: mol_type = other RNA
tggacaagatttttgaaggat

SEQ ID NO: 932 - RNA, 21 nt, synthetic construct
  source 1..21: mol_type = other RNA
ggacaagatttttgaaggaat

SEQ ID NO: 933 - RNA, 21 nt, synthetic construct
  source 1..21: mol_type = other RNA
gacaagatttttgaaggaaat

SEQ ID NO: 934 - RNA, 21 nt, synthetic construct
  source 1..21: mol_type = other RNA
acaagatttttgaaggaaatt

SEQ ID NO: 935 - RNA, 21 nt, synthetic construct
  source 1..21: mol_type = other RNA
caagatttttgaaggaaatat

SEQ ID NO: 936 - RNA, 21 nt, synthetic construct
  source 1..21: mol_type = other RNA
aagatttttgaaggaaatact

SEQ ID NO: 937 - RNA, 21 nt, synthetic construct
  source 1..21: mol_type = other RNA
agatttttgaaggaaatactt

SEQ ID NO: 938 - RNA, 21 nt, synthetic construct
  source 1..21: mol_type = other RNA
gatttttgaaggaaatactat

SEQ ID NO: 939 - RNA, 21 nt, synthetic construct
  source 1..21: mol_type = other RNA
atttttgaaggaaatactaat

SEQ ID NO: 940 - RNA, 21 nt, synthetic construct
  source 1..21: mol_type = other RNA
tttttgaaggaaatactaatt

SEQ ID NO: 941 - RNA, 21 nt, synthetic construct
  source 1..21: mol_type = other RNA
ttttgaaggaaatactaatat

SEQ ID NO: 942 - RNA, 21 nt, synthetic construct
  source 1..21: mol_type = other RNA
tttgaaggaaatactaatact

SEQ ID NO: 943 - RNA, 21 nt, synthetic construct
  source 1..21: mol_type = other RNA
ttgaaggaaatactaatacct

SEQ ID NO: 944 - RNA, 21 nt, synthetic construct
  source 1..21: mol_type = other RNA
actaataccaaaggacatgtt

SEQ ID NO: 945 - RNA, 21 nt, synthetic construct
  source 1..21: mol_type = other RNA
ctaataccaaaggacatgtgt

SEQ ID NO: 946 - RNA, 21 nt, synthetic construct
  source 1..21: mol_type = other RNA
taataccaaaggacatgtgat

SEQ ID NO: 947 - RNA, 21 nt, synthetic construct
  source 1..21: mol_type = other RNA
caatcatttccaggtttatct

SEQ ID NO: 948 - RNA, 21 nt, synthetic construct
  source 1..21: mol_type = other RNA
atcatttccaggtttatccgt

SEQ ID NO: 949 - RNA, 21 nt, synthetic construct
  source 1..21: mol_type = other RNA
atggaatcaaagtattgcact

SEQ ID NO: 950 - RNA, 21 nt, synthetic construct
  source 1..21: mol_type = other RNA
gcctggaactctttggctgtt

SEQ ID NO: 951 - RNA, 23 nt, synthetic construct
  source 1..23: mol_type = other RNA
  modified_base 5: mod_base = OTHER; note = 5'-methyluridine-3'-phosphate
aacgtagaactgccttagctgtg

SEQ ID NO: 952 - RNA, 23 nt, synthetic construct
  source 1..23: mol_type = other RNA
  modified_base 7: mod_base = OTHER; note = 5'-methyluridine-3'-phosphate
agtagctccaactgatgccctga

SEQ ID NO: 953 - RNA, 23 nt, synthetic construct
  source 1..23: mol_type = other RNA
  modified_base 5: mod_base = OTHER; note = 5'-methyluridine-3'-phosphate
atggttcatactctctgtagaca

SEQ ID NO: 954 - RNA, 23 nt, synthetic construct
  source 1..23: mol_type = other RNA
  modified_base 7: mod_base = OTHER; note = 5'-methyluridine-3'-phosphate
atatggttcatactctctgtaga

SEQ ID NO: 955 - RNA, 23 nt, synthetic construct
  source 1..23: mol_type = other RNA
  modified_base 5: mod_base = OTHER; note = 5'-methyluridine-3'-phosphate
aatatggttcatactctctgtag

SEQ ID NO: 956 - RNA, 23 nt, synthetic construct
  source 1..23: mol_type = other RNA
  modified_base 5: mod_base = OTHER; note = 5'-methyluridine-3'-phosphate
aatataaagtaggcccaagaagt

SEQ ID NO: 957 - RNA, 23 nt, synthetic construct
  source 1..23: mol_type = other RNA
  modified_base 7: mod_base = OTHER; note = 5'-methyluridine-3'-phosphate
acgacttcagcatataaagtagg

SEQ ID NO: 958 - RNA, 23 nt, synthetic construct
  source 1..23: mol_type = other RNA
  modified_base 7: mod_base = OTHER; note = 5'-methyluridine-3'-phosphate
accgacttcagcatataaagtag

SEQ ID NO: 959 - RNA, 23 nt, synthetic construct
  source 1..23: mol_type = other RNA
  modified_base 7: mod_base = OTHER; note = 5'-methyluridine-3'-phosphate
agcaccttctgataatttactgt

SEQ ID NO: 960 - RNA, 23 nt, synthetic construct
  source 1..23: mol_type = other RNA
agaagcaccttctgataatttac

SEQ ID NO: 961 - RNA, 23 nt, synthetic construct
  source 1..23: mol_type = other RNA
aggtaagaagcaccttctgataa

SEQ ID NO: 962 - RNA, 23 nt, synthetic construct
  source 1..23: mol_type = other RNA
  modified_base 5: mod_base = OTHER; note = 5'-methyluridine-3'-phosphate
aaggtaagaagcaccttctgata

SEQ ID NO: 963 - RNA, 23 nt, synthetic construct
  source 1..23: mol_type = other RNA
aaaggtaagaagcaccttctgat

SEQ ID NO: 964 - RNA, 23 nt, synthetic construct
  source 1..23: mol_type = other RNA
  modified_base 5: mod_base = OTHER; note = 5'-methyluridine-3'-phosphate
atactccattcataggtgtattc

SEQ ID NO: 965 - RNA, 23 nt, synthetic construct
  source 1..23: mol_type = other RNA
actgatactccattcataggtgt

SEQ ID NO: 966 - RNA, 23 nt, synthetic construct
  source 1..23: mol_type = other RNA
  modified_base 7: mod_base = OTHER; note = 5'-methyluridine-3'-phosphate
aactgatactccattcataggtg

SEQ ID NO: 967 - RNA, 23 nt, synthetic construct
  source 1..23: mol_type = other RNA
  modified_base 7: mod_base = OTHER; note = 5'-methyluridine-3'-phosphate
actcactgatactccattcatag

SEQ ID NO: 968 - RNA, 23 nt, synthetic construct
  source 1..23: mol_type = other RNA
  modified_base 12: mod_base = OTHER; note = 5'-methyluridine-3'-phosphate
aaatagatgtgtgtgaggcatgg

SEQ ID NO: 969 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
ataatagatgtgtgtgaggcatg

SEQ ID NO: 970 - RNA, 23 nt, synthetic construct
  source 1..23: mol_type = other RNA
  modified_base 7: mod_base = OTHER; note = 5'-methyluridine-3'-phosphate
aagtaatagatgtgtgtgaggca

SEQ ID NO: 971 - RNA, 23 nt, synthetic construct
  source 1..23: mol_type = other RNA
  modified_base 7: mod_base = OTHER; note = 5'-methyluridine-3'-phosphate
agggagtaatagatgtgtgtgag

SEQ ID NO: 972 - RNA, 23 nt, synthetic construct
  source 1..23: mol_type = other RNA
attcatgggagtaatagatgtgt

SEQ ID NO: 973 - RNA, 23 nt, synthetic construct
  source 1..23: mol_type = other RNA
  modified_base 7: mod_base = OTHER; note = 5'-methyluridine-3'-phosphate
atttgcttgtcaaacgtcttctg

SEQ ID NO: 974 - RNA, 23 nt, synthetic construct
  source 1..23: mol_type = other RNA
  modified_base 5: mod_base = OTHER; note = 5'-methyluridine-3'-phosphate
agatttgcttgtcaaacgtcttc

SEQ ID NO: 975 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
acgatttgcttgtcaaacgtctt

SEQ ID NO: 976 - RNA, 23 nt, synthetic construct
  source 1..23: mol_type = other RNA
  modified_base 5: mod_base = OTHER; note = 5'-methyluridine-3'-phosphate
acattagggatgatgactggctc

SEQ ID NO: 977 - RNA, 23 nt, synthetic construct
  source 1..23: mol_type = other RNA
atgtacattagggatgatgactg

SEQ ID NO: 978 - RNA, 23 nt, synthetic construct
  source 1..23: mol_type = other RNA
atgtgtacattagggatgatgac

SEQ ID NO: 979 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
actgtgtacattagggatgatga

SEQ ID NO: 980 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
aatccattgactgtgtacattag

SEQ ID NO: 981 - RNA, 23 nt, synthetic construct
  source 1..23: mol_type = other RNA
atatccattgactgtgtacatta

SEQ ID NO: 982 - RNA, 23 nt, synthetic construct
  source 1..23: mol_type = other RNA
  modified_base 7: mod_base = OTHER; note = 5'-methyluridine-3'-phosphate
atggcattgtcccattcacatat

SEQ ID NO: 983 - RNA, 23 nt, synthetic construct
  source 1..23: mol_type = other RNA
  modified_base 12: mod_base = OTHER; note = 5'-methyluridine-3'-phosphate
acacaaactgttatatctggcat

SEQ ID NO: 984 - RNA, 23 nt, synthetic construct
  source 1..23: mol_type = other RNA
  modified_base 12: mod_base = OTHER; note = 5'-methyluridine-3'-phosphate
agcacaaactgttatatctggca

SEQ ID NO: 985 - RNA, 23 nt, synthetic construct
  source 1..23: mol_type = other RNA
  modified_base 5: mod_base = OTHER; note = 5'-methyluridine-3'-phosphate
aaccttatgatggttctgctcca

SEQ ID NO: 986 - RNA, 23 nt, synthetic construct
  source 1..23: mol_type = other RNA
agagaccttatgatggttctgct

SEQ ID NO: 987 - RNA, 23 nt, synthetic construct
  source 1..23: mol_type = other RNA
atgagaccttatgatggttctgc

SEQ ID NO: 988 - RNA, 23 nt, synthetic construct
  source 1..23: mol_type = other RNA
agtagcactgacaagggtgatgg

SEQ ID NO: 989 - RNA, 23 nt, synthetic construct
  source 1..23: mol_type = other RNA
aagtggatgtagcactgacaagg

SEQ ID NO: 990 - RNA, 23 nt, synthetic construct
  source 1..23: mol_type = other RNA
  modified_base 7: mod_base = OTHER; note = 5'-methyluridine-3'-phosphate
acatatttgcggtagtggatgta

SEQ ID NO: 991 - RNA, 23 nt, synthetic construct
  source 1..23: mol_type = other RNA
agtaagcctgcatcccagcttgc

SEQ ID NO: 992 - RNA, 23 nt, synthetic construct
  source 1..23: mol_type = other RNA
atgtaagcctgcatcccagcttg

SEQ ID NO: 993 - RNA, 23 nt, synthetic construct
  source 1..23: mol_type = other RNA
  modified_base 5: mod_base = OTHER; note = 5'-methyluridine-3'-phosphate
aatgtaagcctgcatcccagctt

SEQ ID NO: 994 - RNA, 23 nt, synthetic construct
  source 1..23: mol_type = other RNA
  modified_base 12: mod_base = OTHER; note = 5'-methyluridine-3'-phosphate
aaatgtaagcctgcatcccagct

SEQ ID NO: 995 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
acaatgtaagcctgcatcccagc

SEQ ID NO: 996 - RNA, 23 nt, synthetic construct
  source 1..23: mol_type = other RNA
atcaatgtaagcctgcatcccag

SEQ ID NO: 997 - RNA, 23 nt, synthetic construct
  source 1..23: mol_type = other RNA
  modified_base 7: mod_base = OTHER; note = 5'-methyluridine-3'-phosphate
agtcaatgtaagcctgcatccca

SEQ ID NO: 998 - RNA, 23 nt, synthetic construct
  source 1..23: mol_type = other RNA
atgtcaatgtaagcctgcatccc

SEQ ID NO: 999 - RNA, 23 nt, synthetic construct
  source 1..23: mol_type = other RNA
  modified_base 5: mod_base = OTHER; note = 5'-methyluridine-3'-phosphate
aatgtcaatgtaagcctgcatcc

SEQ ID NO: 1000 - RNA, 23 nt, synthetic construct
  source 1..23: mol_type = other RNA
aaatgtcaatgtaagcctgcatc

SEQ ID NO: 1001 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
ataatgtcaatgtaagcctgcat

SEQ ID NO: 1002 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
atttaatgtcaatgtaagcctgc

SEQ ID NO: 1003 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
attttaatgtcaatgtaagcctg

SEQ ID NO: 1004 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
atttttaatgtcaatgtaagcct

SEQ ID NO: 1005 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
agtttttaatgtcaatgtaagcc

SEQ ID NO: 1006 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
aagtttttaatgtcaatgtaagc

SEQ ID NO: 1007 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
acagtttttaatgtcaatgtaag

SEQ ID NO: 1008 - RNA, 23 nt, synthetic construct
  source 1..23: mol_type = other RNA
  modified_base 7: mod_base = OTHER; note = 5'-methyluridine-3'-phosphate
agcagtttttaatgtcaatgtaa

SEQ ID NO: 1009 - RNA, 23 nt, synthetic construct
  source 1..23: mol_type = other RNA
  modified_base 7: mod_base = OTHER; note = 5'-methyluridine-3'-phosphate
aggcagtttttaatgtcaatgta

SEQ ID NO: 1010 - RNA, 23 nt, synthetic construct
  source 1..23: mol_type = other RNA
agggcagtttttaatgtcaatgt

SEQ ID NO: 1011 - RNA, 23 nt, synthetic construct
  source 1..23: mol_type = other RNA
atgggcagtttttaatgtcaatg

SEQ ID NO: 1012 - RNA, 23 nt, synthetic construct
  source 1..23: mol_type = other RNA
atgcagcaatgaagtattcccac

SEQ ID NO: 1013 - RNA, 23 nt, synthetic construct
  source 1..23: mol_type = other RNA
  modified_base 7: mod_base = OTHER; note = 5'-methyluridine-3'-phosphate
agtgcatagtcccaaatgacttc

SEQ ID NO: 1014 - RNA, 23 nt, synthetic construct
  source 1..23: mol_type = other RNA
  modified_base 5: mod_base = OTHER; note = 5'-methyluridine-3'-phosphate
atattacaggtgcatagtcccaa

SEQ ID NO: 1015 - RNA, 23 nt, synthetic construct
  source 1..23: mol_type = other RNA
aattcgctggtattacaggtgca

SEQ ID NO: 1016 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
accatattcgctggtattacagg

SEQ ID NO: 1017 - RNA, 23 nt, synthetic construct
  source 1..23: mol_type = other RNA
  modified_base 2: mod_base = OTHER; note = 5'-methyluridine-3'-phosphate
atccatattcgctggtattacag

SEQ ID NO: 1018 - RNA, 23 nt, synthetic construct
  source 1..23: mol_type = other RNA
  modified_base 5: mod_base = OTHER; note = 5'-methyluridine-3'-phosphate
attatccaaatgctgagacctgt

SEQ ID NO: 1019 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
atcgtactgtgtgtacataactt

SEQ ID NO: 1020 - RNA, 23 nt, synthetic construct
  source 1..23: mol_type = other RNA
  modified_base 2: mod_base = OTHER; note = 5'-methyluridine-3'-phosphate
attcgtactgtgtgtacataact

SEQ ID NO: 1021 - RNA, 23 nt, synthetic construct
  source 1..23: mol_type = other RNA
  modified_base 5: mod_base = OTHER; note = 5'-methyluridine-3'-phosphate
atcttcgtactgtgtgtacataa

SEQ ID NO: 1022 - RNA, 23 nt, synthetic construct
  source 1..23: mol_type = other RNA
  modified_base 5: mod_base = OTHER; note = 5'-methyluridine-3'-phosphate
aatcttcgtactgtgtgtacata

SEQ ID NO: 1023 - RNA, 23 nt, synthetic construct
  source 1..23: mol_type = other RNA
  modified_base 7: mod_base = OTHER; note = 5'-methyluridine-3'-phosphate
acatcttcgtactgtgtgtacat

SEQ ID NO: 1024 - RNA, 23 nt, synthetic construct
  source 1..23: mol_type = other RNA
agaaggactcatcttcgtactgt

SEQ ID NO: 1025 - RNA, 23 nt, synthetic construct
  source 1..23: mol_type = other RNA
atgaaggactcatcttcgtactg

SEQ ID NO: 1026 - RNA, 23 nt, synthetic construct
  source 1..23: mol_type = other RNA
  modified_base 5: mod_base = OTHER; note = 5'-methyluridine-3'-phosphate
atctttcatattgggattcactg

SEQ ID NO: 1027 - RNA, 23 nt, synthetic construct
  source 1..23: mol_type = other RNA
  modified_base 7: mod_base = OTHER; note = 5'-methyluridine-3'-phosphate
agaaggtcactccatgagggtaa

SEQ ID NO: 1028 - RNA, 23 nt, synthetic construct
  source 1..23: mol_type = other RNA
  modified_base 5: mod_base = OTHER; note = 5'-methyluridine-3'-phosphate
actctgatcatggtgttgttcct

SEQ ID NO: 1029 - RNA, 23 nt, synthetic construct
  source 1..23: mol_type = other RNA
actgctctgatcatggtgttgtt

SEQ ID NO: 1030 - RNA, 23 nt, synthetic construct
  source 1..23: mol_type = other RNA
agaactgctctgatcatggtgtt

SEQ ID NO: 1031 - RNA, 23 nt, synthetic construct
  source 1..23: mol_type = other RNA
agttgaactgctctgatcatggt

SEQ ID NO: 1032 - RNA, 23 nt, synthetic construct
  source 1..23: mol_type = other RNA
  modified_base 5: mod_base = OTHER; note = 5'-methyluridine-3'-phosphate
atggttgaactgctctgatcatg

SEQ ID NO: 1033 - RNA, 23 nt, synthetic construct
  source 1..23: mol_type = other RNA
  modified_base 7: mod_base = OTHER; note = 5'-methyluridine-3'-phosphate
accacttataagtataggtttcc

SEQ ID NO: 1034 - RNA, 23 nt, synthetic construct
  source 1..23: mol_type = other RNA
  modified_base 7: mod_base = OTHER; note = 5'-methyluridine-3'-phosphate
atccacttataagtataggtttc

SEQ ID NO: 1035 - RNA, 23 nt, synthetic construct
  source 1..23: mol_type = other RNA
  modified_base 7: mod_base = OTHER; note = 5'-methyluridine-3'-phosphate
ataagatgttccacttataagta

SEQ ID NO: 1036 - RNA, 23 nt, synthetic construct
  source 1..23: mol_type = other RNA
  modified_base 5: mod_base = OTHER; note = 5'-methyluridine-3'-phosphate
aatctgctcttacagattagaag

SEQ ID NO: 1037 - RNA, 23 nt, synthetic construct
  source 1..23: mol_type = other RNA
agggatctgctcttacagattag

SEQ ID NO: 1038 - RNA, 23 nt, synthetic construct
  source 1..23: mol_type = other RNA
  modified_base 7: mod_base = OTHER; note = 5'-methyluridine-3'-phosphate
agttgatgttgtcctcaaggtac

SEQ ID NO: 1039 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
agctcatgatgtttgattcataa

SEQ ID NO: 1040 - RNA, 23 nt, synthetic construct
  source 1..23: mol_type = other RNA
agtgctcatgatgtttgattcat

SEQ ID NO: 1041 - RNA, 23 nt, synthetic construct
  source 1..23: mol_type = other RNA
aatagccattgatagtgctcatg

SEQ ID NO: 1042 - RNA, 23 nt, synthetic construct
  source 1..23: mol_type = other RNA
aagtgtcatcaaagcagaatcca

SEQ ID NO: 1043 - RNA, 23 nt, synthetic construct
  source 1..23: mol_type = other RNA
  modified_base 5: mod_base = OTHER; note = 5'-methyluridine-3'-phosphate
acactacagaagtgccactggac

SEQ ID NO: 1044 - RNA, 23 nt, synthetic construct
  source 1..23: mol_type = other RNA
  modified_base 7: mod_base = OTHER; note = 5'-methyluridine-3'-phosphate
acacactacagaagtgccactgg

SEQ ID NO: 1045 - RNA, 23 nt, synthetic construct
  source 1..23: mol_type = other RNA
  modified_base 7: mod_base = OTHER; note = 5'-methyluridine-3'-phosphate
aatagatgaatgagtgcccagtg

SEQ ID NO: 1046 - RNA, 23 nt, synthetic construct
  source 1..23: mol_type = other RNA
  modified_base 5: mod_base = OTHER; note = 5'-methyluridine-3'-phosphate
attatccattgtgaccgtcacag

SEQ ID NO: 1047 - RNA, 23 nt, synthetic construct
  source 1..23: mol_type = other RNA
  modified_base 7: mod_base = OTHER; note = 5'-methyluridine-3'-phosphate
agaagttaacatccaagttccaa

SEQ ID NO: 1048 - RNA, 23 nt, synthetic construct
  source 1..23: mol_type = other RNA
  modified_base 12: mod_base = OTHER; note = 5'-methyluridine-3'-phosphate
actagaattcatggaagttaaca

SEQ ID NO: 1049 - RNA, 23 nt, synthetic construct
  source 1..23: mol_type = other RNA
  modified_base 5: mod_base = OTHER; note = 5'-methyluridine-3'-phosphate
aatatgagtcttcatcatcatct

SEQ ID NO: 1050 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
atctcatatgagtcttcatcatc

SEQ ID NO: 1051 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
acctgattcaatgatgagtttcg

SEQ ID NO: 1052 - RNA, 23 nt, synthetic construct
  source 1..23: mol_type = other RNA
acaacaattatatctgtgtttga

SEQ ID NO: 1053 - RNA, 23 nt, synthetic construct
  source 1..23: mol_type = other RNA
  modified_base 12: mod_base = OTHER; note = 5'-methyluridine-3'-phosphate
aaaccaacaattatatctgtgtt

SEQ ID NO: 1054 - RNA, 23 nt, synthetic construct
  source 1..23: mol_type = other RNA
atatagggtcttcagaatatggg

SEQ ID NO: 1055 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
actctatagggtcttcagaatat

SEQ ID NO: 1056 - RNA, 23 nt, synthetic construct
  source 1..23: mol_type = other RNA
agcaccaagtgaaagtagacgta

SEQ ID NO: 1057 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
attatgtgctagtaatttcatcc

SEQ ID NO: 1058 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
aaactttatgtgctagtaatttc

SEQ ID NO: 1059 - RNA, 23 nt, synthetic construct
  source 1..23: mol_type = other RNA
  modified_base 12: mod_base = OTHER; note = 5'-methyluridine-3'-phosphate
acccaactttatgtgctagtaat

SEQ ID NO: 1060 - RNA, 23 nt, synthetic construct
  source 1..23: mol_type = other RNA
acagaagccaaatgccatctccc

SEQ ID NO: 1061 - RNA, 23 nt, synthetic construct
  source 1..23: mol_type = other RNA
  modified_base 7: mod_base = OTHER; note = 5'-methyluridine-3'-phosphate
attggattatttcatagctacct

SEQ ID NO: 1062 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
agtgtcttcatcagtatcttgga

SEQ ID NO: 1063 - RNA, 23 nt, synthetic construct
  source 1..23: mol_type = other RNA
agctgtgtcttcatcagtatctt

SEQ ID NO: 1064 - RNA, 23 nt, synthetic construct
  source 1..23: mol_type = other RNA
  modified_base 7: mod_base = OTHER; note = 5'-methyluridine-3'-phosphate
aattgttaacagctgtgtcttca

SEQ ID NO: 1065 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
atgtctaactctaggaaactttg

SEQ ID NO: 1066 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
agatttatgtctaactctaggaa

SEQ ID NO: 1067 - RNA, 23 nt, synthetic construct
  source 1..23: mol_type = other RNA
  modified_base 2: mod_base = OTHER; note = 5'-methyluridine-3'-phosphate
atccatcctgtcttacttgtaga

SEQ ID NO: 1068 - RNA, 23 nt, synthetic construct
  source 1..23: mol_type = other RNA
attcgtgtcttaatgagaaactg

SEQ ID NO: 1069 - RNA, 23 nt, synthetic construct
  source 1..23: mol_type = other RNA
  modified_base 7: mod_base = OTHER; note = 5'-methyluridine-3'-phosphate
aggagataaaggagcatggtgtg

SEQ ID NO: 1070 - RNA, 23 nt, synthetic construct
  source 1..23: mol_type = other RNA
acttagagggtgaaaggtcctcg

SEQ ID NO: 1071 - RNA, 23 nt, synthetic construct
  source 1..23: mol_type = other RNA
  modified_base 5: mod_base = OTHER; note = 5'-methyluridine-3'-phosphate
atcattggatttatgaagcacca

SEQ ID NO: 1072 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
attcattggatttatgaagcacc

SEQ ID NO: 1073 - RNA, 23 nt, synthetic construct
  source 1..23: mol_type = other RNA
agggaagagatgtttcattggat

SEQ ID NO: 1074 - RNA, 23 nt, synthetic construct
  source 1..23: mol_type = other RNA
  modified_base 7: mod_base = OTHER; note = 5'-methyluridine-3'-phosphate
atctgattatggtcaggaagtga

SEQ ID NO: 1075 - RNA, 23 nt, synthetic construct
  source 1..23: mol_type = other RNA
atcggtcatactcaagcatttca

SEQ ID NO: 1076 - RNA, 23 nt, synthetic construct
  source 1..23: mol_type = other RNA
  modified_base 5: mod_base = OTHER; note = 5'-methyluridine-3'-phosphate
agacttcggtcatactcaagcat

SEQ ID NO: 1077 - RNA, 23 nt, synthetic construct
  source 1..23: mol_type = other RNA
  modified_base 5: mod_base = OTHER; note = 5'-methyluridine-3'-phosphate
attgtgacttcggtcatactcaa

SEQ ID NO: 1078 - RNA, 23 nt, synthetic construct
  source 1..23: mol_type = other RNA
  modified_base 5: mod_base = OTHER; note = 5'-methyluridine-3'-phosphate
agacttgtgacttcggtcatact

SEQ ID NO: 1079 - RNA, 23 nt, synthetic construct
  source 1..23: mol_type = other RNA
  modified_base 7: mod_base = OTHER; note = 5'-methyluridine-3'-phosphate
aaggacttgtgacttcggtcata

SEQ ID NO: 1080 - RNA, 23 nt, synthetic construct
  source 1..23: mol_type = other RNA
aaaggacttgtgacttcggtcat

SEQ ID NO: 1081 - RNA, 23 nt, synthetic construct
  source 1..23: mol_type = other RNA
agaaggacttgtgacttcggtca

SEQ ID NO: 1082 - RNA, 23 nt, synthetic construct
  source 1..23: mol_type = other RNA
  modified_base 5: mod_base = OTHER; note = 5'-methyluridine-3'-phosphate
agtctgactgagttctggagaga

SEQ ID NO: 1083 - RNA, 23 nt, synthetic construct
  source 1..23: mol_type = other RNA
atgtctgactgagttctggagag

SEQ ID NO: 1084 - RNA, 23 nt, synthetic construct
  source 1..23: mol_type = other RNA
agagagaggtttgtctggctgaa

SEQ ID NO: 1085 - RNA, 23 nt, synthetic construct
  source 1..23: mol_type = other RNA
  modified_base 7: mod_base = OTHER; note = 5'-methyluridine-3'-phosphate
actagattcagaagggtagaata

SEQ ID NO: 1086 - RNA, 23 nt, synthetic construct
  source 1..23: mol_type = other RNA
  modified_base 7: mod_base = OTHER; note = 5'-methyluridine-3'-phosphate
aatcattgagagtaggagatgaa

SEQ ID NO: 1087 - RNA, 23 nt, synthetic construct
  source 1..23: mol_type = other RNA
  modified_base 7: mod_base = OTHER; note = 5'-methyluridine-3'-phosphate
agtggattaaattcctttgatag

SEQ ID NO: 1088 - RNA, 23 nt, synthetic construct
  source 1..23: mol_type = other RNA
  modified_base 7: mod_base = OTHER; note = 5'-methyluridine-3'-phosphate
aaccagtggattaaattcctttg

SEQ ID NO: 1089 - RNA, 23 nt, synthetic construct
  source 1..23: mol_type = other RNA
aactataaccagtggattaaatt

SEQ ID NO: 1090 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
acactataaccagtggattaaat

SEQ ID NO: 1091 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
acaatgtaatctgtaccatcttt

SEQ ID NO: 1092 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
actcaatgtaatctgtaccatct

SEQ ID NO: 1093 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
aatgtttgtcctaacatcagttt

SEQ ID NO: 1094 - RNA, 23 nt, synthetic construct
  source 1..23: mol_type = other RNA
  modified_base 7: mod_base = OTHER; note = 5'-methyluridine-3'-phosphate
agatgtttgtcctaacatcagtt

SEQ ID NO: 1095 - RNA, 23 nt, synthetic construct
  source 1..23: mol_type = other RNA
  modified_base 5: mod_base = OTHER; note = 5'-methyluridine-3'-phosphate
ataatcccaggatatttcttcag

SEQ ID NO: 1096 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
agaatatcatcagagtcttcaat

SEQ ID NO: 1097 - RNA, 23 nt, synthetic construct
  source 1..23: mol_type = other RNA
  modified_base 2: mod_base = OTHER; note = 5'-methyluridine-3'-phosphate
attccgagatgctcttcatactc

SEQ ID NO: 1098 - RNA, 23 nt, synthetic construct
  source 1..23: mol_type = other RNA
acaagaattccgagatgctcttc

SEQ ID NO: 1099 - RNA, 23 nt, synthetic construct
  source 1..23: mol_type = other RNA
  modified_base 5: mod_base = OTHER; note = 5'-methyluridine-3'-phosphate
ataataggaccaagaattccgag

SEQ ID NO: 1100 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
atgataataggaccaagaattcc

SEQ ID NO: 1101 - RNA, 23 nt, synthetic construct
  source 1..23: mol_type = other RNA
  modified_base 5: mod_base = OTHER; note = 5'-methyluridine-3'-phosphate
actctgataataggaccaagaat

SEQ ID NO: 1102 - RNA, 23 nt, synthetic construct
  source 1..23: mol_type = other RNA
attcagctctgataataggacca

SEQ ID NO: 1103 - RNA, 23 nt, synthetic construct
  source 1..23: mol_type = other RNA
  modified_base 5: mod_base = OTHER; note = 5'-methyluridine-3'-phosphate
aggataacatcatccacttcagc

SEQ ID NO: 1104 - RNA, 23 nt, synthetic construct
  source 1..23: mol_type = other RNA
  modified_base 2: mod_base = OTHER; note = 5'-methyluridine-3'-phosphate
atggataacatcatccacttcag

SEQ ID NO: 1105 - RNA, 23 nt, synthetic construct
  source 1..23: mol_type = other RNA
  modified_base 12: mod_base = OTHER; note = 5'-methyluridine-3'-phosphate
acataagtctttccctctgatga

SEQ ID NO: 1106 - RNA, 23 nt, synthetic construct
  source 1..23: mol_type = other RNA
  modified_base 5: mod_base = OTHER; note = 5'-methyluridine-3'-phosphate
aatcttcataagtctttccctct

SEQ ID NO: 1107 - RNA, 23 nt, synthetic construct
  source 1..23: mol_type = other RNA
aggtataactgctatttggctga

SEQ ID NO: 1108 - RNA, 23 nt, synthetic construct
  source 1..23: mol_type = other RNA
  modified_base 12: mod_base = OTHER; note = 5'-methyluridine-3'-phosphate
acatacgtaggtataactgctat

SEQ ID NO: 1109 - RNA, 23 nt, synthetic construct
  source 1..23: mol_type = other RNA
aatcaagcctgagtgaatatctt

SEQ ID NO: 1110 - RNA, 23 nt, synthetic construct
  source 1..23: mol_type = other RNA
  modified_base 5: mod_base = OTHER; note = 5'-methyluridine-3'-phosphate
actgtccttatgtagtattcctt

SEQ ID NO: 1111 - RNA, 23 nt, synthetic construct
  source 1..23: mol_type = other RNA
  modified_base 5: mod_base = OTHER; note = 5'-methyluridine-3'-phosphate
aatgttgctgtccttatgtagta

SEQ ID NO: 1112 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
agcatgttgctgtccttatgtag

SEQ ID NO: 1113 - RNA, 23 nt, synthetic construct
  source 1..23: mol_type = other RNA
ataagacaaattctctcatgtcc

SEQ ID NO: 1114 - RNA, 23 nt, synthetic construct
  source 1..23: mol_type = other RNA
agtaagacaaattctctcatgtc

SEQ ID NO: 1115 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
atcttcttttcatcaaaggtcat

SEQ ID NO: 1116 - RNA, 23 nt, synthetic construct
  source 1..23: mol_type = other RNA
  modified_base 5: mod_base = OTHER; note = 5'-methyluridine-3'-phosphate
actcttcttttcatcaaaggtca

SEQ ID NO: 1117 - RNA, 23 nt, synthetic construct
  source 1..23: mol_type = other RNA
  modified_base 7: mod_base = OTHER; note = 5'-methyluridine-3'-phosphate
agctcttcttttcatcaaaggtc

SEQ ID NO: 1118 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
aagctcttcttttcatcaaaggt

SEQ ID NO: 1119 - RNA, 23 nt, synthetic construct
  source 1..23: mol_type = other RNA
acagctcttcttttcatcaaagg

SEQ ID NO: 1120 - RNA, 23 nt, synthetic construct
  source 1..23: mol_type = other RNA
  modified_base 7: mod_base = OTHER; note = 5'-methyluridine-3'-phosphate
accagctcttcttttcatcaaag

SEQ ID NO: 1121 - RNA, 23 nt, synthetic construct
  source 1..23: mol_type = other RNA
aaccagctcttcttttcatcaaa

SEQ ID NO: 1122 - RNA, 23 nt, synthetic construct
  source 1..23: mol_type = other RNA
ataccagctcttcttttcatcaa

SEQ ID NO: 1123 - RNA, 23 nt, synthetic construct
  source 1..23: mol_type = other RNA
agtaccagctcttcttttcatca

SEQ ID NO: 1124 - RNA, 23 nt, synthetic construct
  source 1..23: mol_type = other RNA
aagtaccagctcttcttttcatc

SEQ ID NO: 1125 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
atagtaccagctcttcttttcat

SEQ ID NO: 1126 - RNA, 23 nt, synthetic construct
  source 1..23: mol_type = other RNA
aatagtaccagctcttcttttca

SEQ ID NO: 1127 - RNA, 23 nt, synthetic construct
  source 1..23: mol_type = other RNA
  modified_base 7: mod_base = OTHER; note = 5'-methyluridine-3'-phosphate
acatagtaccagctcttcttttc

SEQ ID NO: 1128 - RNA, 23 nt, synthetic construct
  source 1..23: mol_type = other RNA
  modified_base 5: mod_base = OTHER; note = 5'-methyluridine-3'-phosphate
atcatagtaccagctcttctttt

SEQ ID NO: 1129 - RNA, 23 nt, synthetic construct
  source 1..23: mol_type = other RNA
  modified_base 2: mod_base = OTHER; note = 5'-methyluridine-3'-phosphate
attcatagtaccagctcttcttt

SEQ ID NO: 1130 - RNA, 23 nt, synthetic construct
  source 1..23: mol_type = other RNA
  modified_base 7: mod_base = OTHER; note = 5'-methyluridine-3'-phosphate
atttcatagtaccagctcttctt

SEQ ID NO: 1131 - RNA, 23 nt, synthetic construct
  source 1..23: mol_type = other RNA
  modified_base 5: mod_base = OTHER; note = 5'-methyluridine-3'-phosphate
attttcatagtaccagctcttct

SEQ ID NO: 1132 - RNA, 23 nt, synthetic construct
  source 1..23: mol_type = other RNA
  modified_base 5: mod_base = OTHER; note = 5'-methyluridine-3'-phosphate
acttttcatagtaccagctcttc

SEQ ID NO: 1133 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 7: mod_base = OTHER; note = 5'-methyluridine-3'-phosphate
atcttttcatagtaccagctctt

SEQ ID NO: 1134 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
attcttttcatagtaccagctct

SEQ ID NO: 1135 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
acttcttttcatagtaccagctc

SEQ ID NO: 1136 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
aacttcttttcatagtaccagct

SEQ ID NO: 1137 - RNA, 23 nt, synthetic construct
  source 1..23: mol_type = other RNA
atgagtctccaagaacttcggga

SEQ ID NO: 1138 - RNA, 23 nt, synthetic construct
  source 1..23: mol_type = other RNA
atgtgagtctccaagaacttcgg

SEQ ID NO: 1139 - RNA, 23 nt, synthetic construct
  source 1..23: mol_type = other RNA
  modified_base 12: mod_base = OTHER; note = 5'-methyluridine-3'-phosphate
aatcccattaatggcgtgaaact

SEQ ID NO: 1140 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
actgtagatcatcccattaatgg

SEQ ID NO: 1141 - RNA, 23 nt, synthetic construct
  source 1..23: mol_type = other RNA
  modified_base 12: mod_base = OTHER; note = 5'-methyluridine-3'-phosphate
acacgtgaatgtcttgggagccg

SEQ ID NO: 1142 - RNA, 23 nt, synthetic construct
  source 1..23: mol_type = other RNA
agaaccacgtgaatgtcttggga

SEQ ID NO: 1143 - RNA, 23 nt, synthetic construct
  source 1..23: mol_type = other RNA
atgaaagtgaaccacgtgaatgt

SEQ ID NO: 1144 - RNA, 23 nt, synthetic construct
  source 1..23: mol_type = other RNA
aataagaaatggcgtttgcatcc

SEQ ID NO: 1145 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
atgataagaaatggcgtttgcat

SEQ ID NO: 1146 - RNA, 23 nt, synthetic construct
  source 1..23: mol_type = other RNA
aagtctctgtccatgataagaaa

SEQ ID NO: 1147 - RNA, 23 nt, synthetic construct
  source 1..23: mol_type = other RNA
aacagtctctgtccatgataaga

SEQ ID NO: 1148 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
aagatatgataccagtgcttagt

SEQ ID NO: 1149 - RNA, 23 nt, synthetic construct
  source 1..23: mol_type = other RNA
agatctgtgaatcagatatgata

SEQ ID NO: 1150 - RNA, 23 nt, synthetic construct
  source 1..23: mol_type = other RNA
aataagatccaccattgtttaat

SEQ ID NO: 1151 - RNA, 23 nt, synthetic construct
  source 1..23: mol_type = other RNA
  modified_base 2: mod_base = OTHER; note = 5'-methyluridine-3'-phosphate
atataagatccaccattgtttaa

SEQ ID NO: 1152 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
acattataagatccaccattgtt

SEQ ID NO: 1153 - RNA, 23 nt, synthetic construct
  source 1..23: mol_type = other RNA
acaagcattataagatccaccat

SEQ ID NO: 1154 - RNA, 23 nt, synthetic construct
  source 1..23: mol_type = other RNA
  modified_base 5: mod_base = OTHER; note = 5'-methyluridine-3'-phosphate
acactccaagcattataagatcc

SEQ ID NO: 1155 - RNA, 23 nt, synthetic construct
  source 1..23: mol_type = other RNA
  modified_base 5: mod_base = OTHER; note = 5'-methyluridine-3'-phosphate
aaggtagtgtttggcaccttggg

SEQ ID NO: 1156 - RNA, 23 nt, synthetic construct
  source 1..23: mol_type = other RNA
agaactctgtggtatagcaggac

SEQ ID NO: 1157 - RNA, 23 nt, synthetic construct
  source 1..23: mol_type = other RNA
  modified_base 5: mod_base = OTHER; note = 5'-methyluridine-3'-phosphate
aacatagaactctgtggtatagc

SEQ ID NO: 1158 - RNA, 23 nt, synthetic construct
  source 1..23: mol_type = other RNA
  modified_base 7: mod_base = OTHER; note = 5'-methyluridine-3'-phosphate
actacatagaactctgtggtata

SEQ ID NO: 1159 - RNA, 23 nt, synthetic construct
  source 1..23: mol_type = other RNA
  modified_base 5: mod_base = OTHER; note = 5'-methyluridine-3'-phosphate
aagctacatagaactctgtggta

SEQ ID NO: 1160 - RNA, 23 nt, synthetic construct
  source 1..23: mol_type = other RNA
aaagctacatagaactctgtggt

SEQ ID NO: 1161 - RNA, 23 nt, synthetic construct
  source 1..23: mol_type = other RNA
atgtaagctacatagaactctgt

SEQ ID NO: 1162 - RNA, 23 nt, synthetic construct
  source 1..23: mol_type = other RNA
aactgtaagctacatagaactct

SEQ ID NO: 1163 - RNA, 23 nt, synthetic construct
  source 1..23: mol_type = other RNA
  modified_base 7: mod_base = OTHER; note = 5'-methyluridine-3'-phosphate
aggaactgtaagctacatagaac

SEQ ID NO: 1164 - RNA, 23 nt, synthetic construct
  source 1..23: mol_type = other RNA
  modified_base 5: mod_base = OTHER; note = 5'-methyluridine-3'-phosphate
attgtagaggcatctgaattgcc

SEQ ID NO: 1165 - RNA, 23 nt, synthetic construct
  source 1..23: mol_type = other RNA
aattgtagaggcatctgaattgc

SEQ ID NO: 1166 - RNA, 23 nt, synthetic construct
  source 1..23: mol_type = other RNA
  modified_base 5: mod_base = OTHER; note = 5'-methyluridine-3'-phosphate
attattgtagaggcatctgaatt

SEQ ID NO: 1167 - RNA, 23 nt, synthetic construct
  source 1..23: mol_type = other RNA
aaataggtgggtcaaactgattc

SEQ ID NO: 1168 - RNA, 23 nt, synthetic construct
  source 1..23: mol_type = other RNA
  modified_base 5: mod_base = OTHER; note = 5'-methyluridine-3'-phosphate
acaataggtgggtcaaactgatt

SEQ ID NO: 1169 - RNA, 23 nt, synthetic construct
  source 1..23: mol_type = other RNA
aacaataggtgggtcaaactgat

SEQ ID NO: 1170 - RNA, 23 nt, synthetic construct
  source 1..23: mol_type = other RNA
aaatatatctagccacaataggt

SEQ ID NO: 1171 - RNA, 23 nt, synthetic construct
  source 1..23: mol_type = other RNA
  modified_base 5: mod_base = OTHER; note = 5'-methyluridine-3'-phosphate
aagatcctaatatatctagccac

SEQ ID NO: 1172 - RNA, 23 nt, synthetic construct
  source 1..23: mol_type = other RNA
atggagagatcctaatatatcta

SEQ ID NO: 1173 - RNA, 23 nt, synthetic construct
  source 1..23: mol_type = other RNA
acgaagaagctgtgatttgcttg

SEQ ID NO: 1174 - RNA, 23 nt, synthetic construct
  source 1..23: mol_type = other RNA
atagatcaatttctagccactgc

SEQ ID NO: 1175 - RNA, 23 nt, synthetic construct
  source 1..23: mol_type = other RNA
  modified_base 7: mod_base = OTHER; note = 5'-methyluridine-3'-phosphate
agatcttgagtagatcaatttct

SEQ ID NO: 1176 - RNA, 23 nt, synthetic construct
  source 1..23: mol_type = other RNA
  modified_base 7: mod_base = OTHER; note = 5'-methyluridine-3'-phosphate
aatagctctttacatacatttca

SEQ ID NO: 1177 - RNA, 23 nt, synthetic construct
  source 1..23: mol_type = other RNA
  modified_base 7: mod_base = OTHER; note = 5'-methyluridine-3'-phosphate
agatggtatagctctttacatac

SEQ ID NO: 1178 - RNA, 23 nt, synthetic construct
  source 1..23: mol_type = other RNA
  modified_base 5: mod_base = OTHER; note = 5'-methyluridine-3'-phosphate
atagtggatggtatagctcttta

SEQ ID NO: 1179 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
aaaatcttgtccaccatggagga

SEQ ID NO: 1180 - RNA, 23 nt, synthetic construct
  source 1..23: mol_type = other RNA
aaaaatcttgtccaccatggagg

SEQ ID NO: 1181 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
aaaaaatcttgtccaccatggag

SEQ ID NO: 1182 - RNA, 23 nt, synthetic construct
  source 1..23: mol_type = other RNA
acaaaaatcttgtccaccatgga

SEQ ID NO: 1183 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
atcaaaaatcttgtccaccatgg

SEQ ID NO: 1184 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
attcaaaaatcttgtccaccatg

SEQ ID NO: 1185 - RNA, 23 nt, synthetic construct
  source 1..23: mol_type = other RNA
acttcaaaaatcttgtccaccat

SEQ ID NO: 1186 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
accttcaaaaatcttgtccacca

SEQ ID NO: 1187 - RNA, 23 nt, synthetic construct
  source 1..23: mol_type = other RNA
  modified_base 5: mod_base = OTHER; note = 5'-methyluridine-3'-phosphate
atccttcaaaaatcttgtccacc

SEQ ID NO: 1188 - RNA, 23 nt, synthetic construct
  source 1..23: mol_type = other RNA
  modified_base 7: mod_base = OTHER; note = 5'-methyluridine-3'-phosphate
attccttcaaaaatcttgtccac

SEQ ID NO: 1189 - RNA, 23 nt, synthetic construct
  source 1..23: mol_type = other RNA
  modified_base 7: mod_base = OTHER; note = 5'-methyluridine-3'-phosphate
atttccttcaaaaatcttgtcca

SEQ ID NO: 1190 - RNA, 23 nt, synthetic construct
  source 1..23: mol_type = other RNA
  modified_base 5: mod_base = OTHER; note = 5'-methyluridine-3'-phosphate
aatttccttcaaaaatcttgtcc

SEQ ID NO: 1191 - RNA, 23 nt, synthetic construct
  source 1..23: mol_type = other RNA
  modified_base 5: mod_base = OTHER; note = 5'-methyluridine-3'-phosphate
atatttccttcaaaaatcttgtc

SEQ ID NO: 1192 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
agtatttccttcaaaaatcttgt

SEQ ID NO: 1193 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
aagtatttccttcaaaaatcttg

SEQ ID NO: 1194 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
atagtatttccttcaaaaatctt

SEQ ID NO: 1195 - RNA, 23 nt, synthetic construct
  source 1..23: mol_type = other RNA
attagtatttccttcaaaaatct

SEQ ID NO: 1196 - RNA, 23 nt, synthetic construct
  source 1..23: mol_type = other RNA
  modified_base 7: mod_base = OTHER; note = 5'-methyluridine-3'-phosphate
aattagtatttccttcaaaaatc

SEQ ID NO: 1197 - RNA, 23 nt, synthetic construct
  source 1..23: mol_type = other RNA
  modified_base 5: mod_base = OTHER; note = 5'-methyluridine-3'-phosphate
atattagtatttccttcaaaaat

SEQ ID NO: 1198 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
agtattagtatttccttcaaaaa

SEQ ID NO: 1199 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
aggtattagtatttccttcaaaa

SEQ ID NO: 1200 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
aacatgtcctttggtattagtat

SEQ ID NO: 1201 - RNA, 23 nt, synthetic construct
  source 1..23: mol_type = other RNA
  modified_base 12: mod_base = OTHER; note = 5'-methyluridine-3'-phosphate
acacatgtcctttggtattagta

SEQ ID NO: 1202 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
atcacatgtcctttggtattagt

SEQ ID NO: 1203 - RNA, 23 nt, synthetic construct
  source 1..23: mol_type = other RNA
agataaacctggaaatgattggg

SEQ ID NO: 1204 - RNA, 23 nt, synthetic construct
  source 1..23: mol_type = other RNA
  modified_base 12: mod_base = OTHER; note = 5'-methyluridine-3'-phosphate
acggataaacctggaaatgattg

SEQ ID NO: 1205 - RNA, 23 nt, synthetic construct
  source 1..23: mol_type = other RNA
agtgcaatactttgattccatgt

SEQ ID NO: 1206 - RNA, 23 nt, synthetic construct
  source 1..23: mol_type = other RNA
aacagccaaagagttccaggcga

SEQ ID NO: 1207 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagctaaggcagttctacgtt

SEQ ID NO: 1208 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agggcatcagttggagctact

SEQ ID NO: 1209 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctacagagagtatgaaccat

SEQ ID NO: 1210 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacagagagtatgaaccatat

SEQ ID NO: 1211 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acagagagtatgaaccatatt

SEQ ID NO: 1212 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcttgggcctactttatatt

SEQ ID NO: 1213 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tactttatatgctgaagtcgt

SEQ ID NO: 1214 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actttatatgctgaagtcggt

SEQ ID NO: 1215 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtaaattatcagaaggtgct

SEQ ID NO: 1216 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaattatcagaaggtgcttct

SEQ ID NO: 1217 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcagaaggtgcttcttacct

SEQ ID NO: 1218 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcagaaggtgcttcttacctt

SEQ ID NO: 1219 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaggtgcttcttaccttt

SEQ ID NO: 1220 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atacacctatgaatggagtat

SEQ ID NO: 1221 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acctatgaatggagtatcagt

SEQ ID NO: 1222 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctatgaatggagtatcagtt

SEQ ID NO: 1223 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgaatggagtatcagtgagt

SEQ ID NO: 1224 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcctcacacacatctattt

SEQ ID NO: 1225 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcctcacacacatctattat

SEQ ID NO: 1226 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcctcacacacatctattact

SEQ ID NO: 1227 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctcacacacatctattactt

SEQ ID NO: 1228 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctcacacacatctattactct

SEQ ID NO: 1229 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacacacatctattactccct

SEQ ID NO: 1230 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acatctattactcccatgaat

SEQ ID NO: 1231 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagacgtttgacaagcaaat

SEQ ID NO: 1232 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agacgtttgacaagcaaatct

SEQ ID NO: 1233 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacgtttgacaagcaaatcgt

SEQ ID NO: 1234 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gccagtcatcatccctaatgt

SEQ ID NO: 1235 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcatcatccctaatgtacat

SEQ ID NO: 1236 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catcatccctaatgtacacat

SEQ ID NO: 1237 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcatccctaatgtacacagt

SEQ ID NO: 1238 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgtacacagtcaatggatt

SEQ ID NO: 1239 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtacacagtcaatggatat

SEQ ID NO: 1240 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtgaatgggacaatgccat

SEQ ID NO: 1241 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gccagatataacagtttgtgt

SEQ ID NO: 1242 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccagatataacagtttgtgct

SEQ ID NO: 1243 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcagaaccatcataaggtt

SEQ ID NO: 1244 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagaaccatcataaggtctct

SEQ ID NO: 1245 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaaccatcataaggtctcat

SEQ ID NO: 1246 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcacccttgtcagtgctact

SEQ ID NO: 1247 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgtcagtgctacatccactt

SEQ ID NO: 1248 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catccactaccgcaaatatgt

SEQ ID NO: 1249 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagctgggatgcaggcttact

SEQ ID NO: 1250 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agctgggatgcaggcttacat

SEQ ID NO: 1251 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctgggatgcaggcttacatt

SEQ ID NO: 1252 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgggatgcaggcttacattt

SEQ ID NO: 1253 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggatgcaggcttacattgt

SEQ ID NO: 1254 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggatgcaggcttacattgat

SEQ ID NO: 1255 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggatgcaggcttacattgact

SEQ ID NO: 1256 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatgcaggcttacattgacat

SEQ ID NO: 1257 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcaggcttacattgacatt

SEQ ID NO: 1258 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcaggcttacattgacattt

SEQ ID NO: 1259 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaggcttacattgacattat

SEQ ID NO: 1260 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggcttacattgacattaaat

SEQ ID NO: 1261 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggcttacattgacattaaaat

SEQ ID NO: 1262 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttacattgacattaaaaat

SEQ ID NO: 1263 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttacattgacattaaaaact

SEQ ID NO: 1264 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttacattgacattaaaaactt

SEQ ID NO: 1265 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacattgacattaaaaactgt

SEQ ID NO: 1266 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acattgacattaaaaactgct

SEQ ID NO: 1267 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cattgacattaaaaactgcct

SEQ ID NO: 1268 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgacattaaaaactgccct

SEQ ID NO: 1269 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgacattaaaaactgcccat

SEQ ID NO: 1270 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggaatacttcattgctgcat

SEQ ID NO: 1271 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtcatttgggactatgcact

SEQ ID NO: 1272 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggactatgcacctgtaatat

SEQ ID NO: 1273 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacctgtaataccagcgaatt

SEQ ID NO: 1274 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtaataccagcgaatatggt

SEQ ID NO: 1275 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtaataccagcgaatatggat

SEQ ID NO: 1276 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggtctcagcatttggataat

SEQ ID NO: 1277 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttatgtacacacagtacgat

SEQ ID NO: 1278 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatgtacacacagtacgaat

SEQ ID NO: 1279 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtacacacagtacgaagat

SEQ ID NO: 1280 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtacacacagtacgaagatt

SEQ ID NO: 1281 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtacacacagtacgaagatgt

SEQ ID NO: 1282 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtacgaagatgagtccttct

SEQ ID NO: 1283 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtacgaagatgagtccttcat

SEQ ID NO: 1284 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgaatcccaatatgaaagat

SEQ ID NO: 1285 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accctcatggagtgaccttct

SEQ ID NO: 1286 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaacaacaccatgatcagagt

SEQ ID NO: 1287 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caacaccatgatcagagcagt

SEQ ID NO: 1288 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caccatgatcagagcagttct

SEQ ID NO: 1289 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catgatcagagcagttcaact

SEQ ID NO: 1290 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatcagagcagttcaaccat

SEQ ID NO: 1291 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaacctatacttataagtggt

SEQ ID NO: 1292 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacctatacttataagtggat

SEQ ID NO: 1293 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttataagtggaacatcttat

SEQ ID NO: 1294 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctaatctgtaagagcagatt

SEQ ID NO: 1295 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatctgtaagagcagatccct

SEQ ID NO: 1296 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accttgaggacaacatcaact

SEQ ID NO: 1297 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgaatcaaacatcatgagct

SEQ ID NO: 1298 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaatcaaacatcatgagcact

SEQ ID NO: 1299 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgagcactatcaatggctatt

SEQ ID NO: 1300 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gattctgctttgatgacactt

SEQ ID NO: 1301 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccagtggcacttctgtagtgt

SEQ ID NO: 1302 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtggcacttctgtagtgtgt

SEQ ID NO: 1303 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgggcactcattcatctatt

SEQ ID NO: 1304 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacggtcacaatggataat

SEQ ID NO: 1305 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggaacttggatgttaacttct

SEQ ID NO: 1306 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttaacttccatgaattctagt

SEQ ID NO: 1307 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgatgatgaagactcatatt

SEQ ID NO: 1308 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatgaagactcatatgagat

SEQ ID NO: 1309 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaactcatcattgaatcaggt

SEQ ID NO: 1310 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaacacagatataattgttgt

SEQ ID NO: 1311 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacagatataattgttggttt

SEQ ID NO: 1312 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catattctgaagaccctatat

SEQ ID NO: 1313 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attctgaagaccctatagagt

SEQ ID NO: 1314 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgtctactttcacttggtgct

SEQ ID NO: 1315 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgaaattactagcacataat

SEQ ID NO: 1316 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattactagcacataaagttt

SEQ ID NO: 1317 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tactagcacataaagttgggt

SEQ ID NO: 1318 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagatggcatttggcttctgt

SEQ ID NO: 1319 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtagctatgaaataatccaat

SEQ ID NO: 1320 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagatactgatgaagacact

SEQ ID NO: 1321 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatactgatgaagacacagct

SEQ ID NO: 1322 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagacacagctgttaacaatt

SEQ ID NO: 1323 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagtttcctagagttagacat

SEQ ID NO: 1324 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctagagttagacataaatct

SEQ ID NO: 1325 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaagtaagacaggatggat

SEQ ID NO: 1326 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtttctcattaagacacgaat

SEQ ID NO: 1327 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caccatgctcctttatctcct

SEQ ID NO: 1328 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggacctttcaccctctaagt

SEQ ID NO: 1329 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgcttcataaatccaatgat

SEQ ID NO: 1330 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcttcataaatccaatgaat

SEQ ID NO: 1331 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaatgaaacatctcttccct

SEQ ID NO: 1332 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acttcctgaccataatcagat

SEQ ID NO: 1333 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatgcttgagtatgaccgat

SEQ ID NO: 1334 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttgagtatgaccgaagtct

SEQ ID NO: 1335 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagtatgaccgaagtcacaat

SEQ ID NO: 1336 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgaccgaagtcacaagtct

SEQ ID NO: 1337 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaccgaagtcacaagtcctt

SEQ ID NO: 1338 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaccgaagtcacaagtccttt

SEQ ID NO: 1339 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accgaagtcacaagtccttct

SEQ ID NO: 1340 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctccagaactcagtcagact

SEQ ID NO: 1341 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctccagaactcagtcagacat

SEQ ID NO: 1342 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagccagacaaacctctctct

SEQ ID NO: 1343 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttctacccttctgaatctagt

SEQ ID NO: 1344 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catctcctactctcaatgatt

SEQ ID NO: 1345 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcaaaggaatttaatccact

SEQ ID NO: 1346 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaggaatttaatccactggtt

SEQ ID NO: 1347 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttaatccactggttatagtt

SEQ ID NO: 1348 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttaatccactggttatagtgt

SEQ ID NO: 1349 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agatggtacagattacattgt

SEQ ID NO: 1350 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtacagattacattgagt

SEQ ID NO: 1351 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actgatgttaggacaaacatt

SEQ ID NO: 1352 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgatgttaggacaaacatct

SEQ ID NO: 1353 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagaaatatcctgggattat

SEQ ID NO: 1354 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaagactctgatgatattct

SEQ ID NO: 1355 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtatgaagagcatctcggaat

SEQ ID NO: 1356 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagcatctcggaattcttgt

SEQ ID NO: 1357 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cggaattcttggtcctattat

SEQ ID NO: 1358 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattcttggtcctattatcat

SEQ ID NO: 1359 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcttggtcctattatcagagt

SEQ ID NO: 1360 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcctattatcagagctgaat

SEQ ID NO: 1361 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaagtggatgatgttatcct

SEQ ID NO: 1362 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagtggatgatgttatccat

SEQ ID NO: 1363 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcagagggaaagacttatgt

SEQ ID NO: 1364 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agggaaagacttatgaagatt

SEQ ID NO: 1365 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agccaaatagcagttatacct

SEQ ID NO: 1366 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcagttatacctacgtatgt

SEQ ID NO: 1367 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatattcactcaggcttgatt

SEQ ID NO: 1368 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggaatactacataaggacagt

SEQ ID NO: 1369 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctacataaggacagcaacatt

SEQ ID NO: 1370 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acataaggacagcaacatgct

SEQ ID NO: 1371 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acatgagagaatttgtcttat

SEQ ID NO: 1372 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catgagagaatttgtcttact

SEQ ID NO: 1373 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagagaatttgtcttactatt

SEQ ID NO: 1374 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacctttgatgaaaagaagat

SEQ ID NO: 1375 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acctttgatgaaaagaagagt

SEQ ID NO: 1376 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctttgatgaaaagaagagct

SEQ ID NO: 1377 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctttgatgaaaagaagagctt

SEQ ID NO: 1378 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttgatgaaaagaagagctgt

SEQ ID NO: 1379 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgatgaaaagaagagctggt

SEQ ID NO: 1380 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatgaaaagaagagctggtt

SEQ ID NO: 1381 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatgaaaagaagagctggtat

SEQ ID NO: 1382 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgaaaagaagagctggtact

SEQ ID NO: 1383 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaaaagaagagctggtactt

SEQ ID NO: 1384 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaaagaagagctggtactat

SEQ ID NO: 1385 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaagaagagctggtactatt

SEQ ID NO: 1386 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagaagagctggtactatgt

SEQ ID NO: 1387 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagaagagctggtactatgat

SEQ ID NO: 1388 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaagagctggtactatgaat

SEQ ID NO: 1389 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagagctggtactatgaaat

SEQ ID NO: 1390 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagagctggtactatgaaaat

SEQ ID NO: 1391 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagctggtactatgaaaagt

SEQ ID NO: 1392 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagctggtactatgaaaagat

SEQ ID NO: 1393 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agctggtactatgaaaagaat

SEQ ID NO: 1394 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctggtactatgaaaagaagt

SEQ ID NO: 1395 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggtactatgaaaagaagtt

SEQ ID NO: 1396 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccgaagttcttggagactcat

SEQ ID NO: 1397 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagttcttggagactcacat

SEQ ID NO: 1398 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttcacgccattaatgggatt

SEQ ID NO: 1399 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attaatgggatgatctacagt

SEQ ID NO: 1400 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcccaagacattcacgtgt

SEQ ID NO: 1401 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaagacattcacgtggttct

SEQ ID NO: 1402 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attcacgtggttcactttcat

SEQ ID NO: 1403 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcaaacgccatttcttatt

SEQ ID NO: 1404 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaacgccatttcttatcat

SEQ ID NO: 1405 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcttatcatggacagagactt

SEQ ID NO: 1406 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatcatggacagagactgtt

SEQ ID NO: 1407 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taagcactggtatcatatctt

SEQ ID NO: 1408 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcatatctgattcacagatct

SEQ ID NO: 1409 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taaacaatggtggatcttatt

SEQ ID NO: 1410 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaacaatggtggatcttatat

SEQ ID NO: 1411 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatggtggatcttataatgt

SEQ ID NO: 1412 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggtggatcttataatgcttgt

SEQ ID NO: 1413 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcttataatgcttggagtgt

SEQ ID NO: 1414 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaggtgccaaacactacctt

SEQ ID NO: 1415 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctgctataccacagagttct

SEQ ID NO: 1416 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgctataccacagagttctt

SEQ ID NO: 1417 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tataccacagagttctatgtt

SEQ ID NO: 1418 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taccacagagttctatgtagt

SEQ ID NO: 1419 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccacagagttctatgtagctt

SEQ ID NO: 1420 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacagagttctatgtagcttt

SEQ ID NO: 1421 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagttctatgtagcttacat

SEQ ID NO: 1422 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agttctatgtagcttacagtt

SEQ ID NO: 1423 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctatgtagcttacagttcct

SEQ ID NO: 1424 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caattcagatgcctctacaat

SEQ ID NO: 1425 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattcagatgcctctacaatt

SEQ ID NO: 1426 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcagatgcctctacaataat

SEQ ID NO: 1427 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcagtttgacccacctattt

SEQ ID NO: 1428 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcagtttgacccacctattgt

SEQ ID NO: 1429 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagtttgacccacctattgtt

SEQ ID NO: 1430 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctattgtggctagatatattt

SEQ ID NO: 1431 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggctagatatattaggatctt

SEQ ID NO: 1432 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatatattaggatctctccat

SEQ ID NO: 1433 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcaaatcacagcttcttcgt

SEQ ID NO: 1434 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtggctagaaattgatctat

SEQ ID NO: 1435 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaattgatctactcaagatct

SEQ ID NO: 1436 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatgtatgtaaagagctatt

SEQ ID NO: 1437 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtaaagagctataccatct

SEQ ID NO: 1438 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagagctataccatccactat

SEQ ID NO: 1439 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctccatggtggacaagatttt

SEQ ID NO: 1440 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccatggtggacaagattttt

SEQ ID NO: 1441 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccatggtggacaagatttttt

SEQ ID NO: 1442 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catggtggacaagatttttgt

SEQ ID NO: 1443 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtggacaagatttttgat

SEQ ID NO: 1444 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtggacaagatttttgaat

SEQ ID NO: 1445 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggtggacaagatttttgaagt

SEQ ID NO: 1446 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggacaagatttttgaaggt

SEQ ID NO: 1447 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggacaagatttttgaaggat

SEQ ID NO: 1448 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggacaagatttttgaaggaat

SEQ ID NO: 1449 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacaagatttttgaaggaaat

SEQ ID NO: 1450 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaagatttttgaaggaaatt

SEQ ID NO: 1451 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagatttttgaaggaaatat

SEQ ID NO: 1452 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagatttttgaaggaaatact

SEQ ID NO: 1453 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agatttttgaaggaaatactt

SEQ ID NO: 1454 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatttttgaaggaaatactat

SEQ ID NO: 1455 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atttttgaaggaaatactaat

SEQ ID NO: 1456 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttttgaaggaaatactaatt

SEQ ID NO: 1457 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttttgaaggaaatactaatat

SEQ ID NO: 1458 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttgaaggaaatactaatact

SEQ ID NO: 1459 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgaaggaaatactaatacct

SEQ ID NO: 1460 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actaataccaaaggacatgtt

SEQ ID NO: 1461 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctaataccaaaggacatgtgt

SEQ ID NO: 1462 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taataccaaaggacatgtgat

SEQ ID NO: 1463 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatcatttccaggtttatct

SEQ ID NO: 1464 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcatttccaggtttatccgt

SEQ ID NO: 1465 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggaatcaaagtattgcact

SEQ ID NO: 1466 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcctggaactctttggctgtt

SEQ ID NO: 1467 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aacgtagaactgccttagctgtg

SEQ ID NO: 1468 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agtagctccaactgatgccctga

SEQ ID NO: 1469 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atggttcatactctctgtagaca

SEQ ID NO: 1470 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atatggttcatactctctgtaga

SEQ ID NO: 1471 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
aatatggttcatactctctgtag

SEQ ID NO: 1472 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatataaagtaggcccaagaagt

SEQ ID NO: 1473 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acgacttcagcatataaagtagg

SEQ ID NO: 1474 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
accgacttcagcatataaagtag

SEQ ID NO: 1475 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agcaccttctgataatttactgt

SEQ ID NO: 1476 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
agaagcaccttctgataatttac

SEQ ID NO: 1477 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggtaagaagcaccttctgataa

SEQ ID NO: 1478 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaggtaagaagcaccttctgata

SEQ ID NO: 1479 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaggtaagaagcaccttctgat

SEQ ID NO: 1480 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
atactccattcataggtgtattc

SEQ ID NO: 1481 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actgatactccattcataggtgt

SEQ ID NO: 1482 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aactgatactccattcataggtg

SEQ ID NO: 1483 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actcactgatactccattcatag

SEQ ID NO: 1484 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaatagatgtgtgtgaggcatgg

SEQ ID NO: 1485 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ataatagatgtgtgtgaggcatg

SEQ ID NO: 1486 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtaatagatgtgtgtgaggcat

SEQ ID NO: 1487 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagtaatagatgtgtgtgaggca

SEQ ID NO: 1488 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agagtaatagatgtgtgtgaggc

SEQ ID NO: 1489 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
agggagtaatagatgtgtgtgag

SEQ ID NO: 1490 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
attcatgggagtaatagatgtgt

SEQ ID NO: 1491 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atttgcttgtcaaacgtcttctg

SEQ ID NO: 1492 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
agatttgcttgtcaaacgtcttc

SEQ ID NO: 1493 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acgatttgcttgtcaaacgtctt

SEQ ID NO: 1494 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acattagggatgatgactggctc

SEQ ID NO: 1495 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atgtacattagggatgatgactg

SEQ ID NO: 1496 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
atgtgtacattagggatgatgac

SEQ ID NO: 1497 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
actgtgtacattagggatgatga

SEQ ID NO: 1498 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatccattgactgtgtacattag

SEQ ID NO: 1499 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atatccattgactgtgtacatta

SEQ ID NO: 1500 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
atggcattgtcccattcacatat

SEQ ID NO: 1501 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acacaaactgttatatctggcat

SEQ ID NO: 1502 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agcacaaactgttatatctggca

SEQ ID NO: 1503 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaccttatgatggttctgctcca

SEQ ID NO: 1504 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agagaccttatgatggttctgct

SEQ ID NO: 1505 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
atgagaccttatgatggttctgc

SEQ ID NO: 1506 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
agtagcactgacaagggtgatgg

SEQ ID NO: 1507 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
aagtggatgtagcactgacaagg

SEQ ID NO: 1508 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acatatttgcggtagtggatgta

SEQ ID NO: 1509 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
agtaagcctgcatcccagcttgc

SEQ ID NO: 1510 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atgtaagcctgcatcccagcttg

SEQ ID NO: 1511 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatgtaagcctgcatcccagctt

SEQ ID NO: 1512 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaatgtaagcctgcatcccagct

SEQ ID NO: 1513 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acaatgtaagcctgcatcccagc

SEQ ID NO: 1514 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atcaatgtaagcctgcatcccag

SEQ ID NO: 1515 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtcaatgtaagcctgcatccca

SEQ ID NO: 1516 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
atgtcaatgtaagcctgcatccc

SEQ ID NO: 1517 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatgtcaatgtaagcctgcatcc

SEQ ID NO: 1518 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
aaatgtcaatgtaagcctgcatc

SEQ ID NO: 1519 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ataatgtcaatgtaagcctgcat

SEQ ID NO: 1520 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
attaatgtcaatgtaagcctgca

SEQ ID NO: 1521 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atttaatgtcaatgtaagcctgc

SEQ ID NO: 1522 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
attttaatgtcaatgtaagcctg

SEQ ID NO: 1523 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atttttaatgtcaatgtaagcct

SEQ ID NO: 1524 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtttttaatgtcaatgtaagcc

SEQ ID NO: 1525 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagtttttaatgtcaatgtaagc

SEQ ID NO: 1526 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acagtttttaatgtcaatgtaag

SEQ ID NO: 1527 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agcagtttttaatgtcaatgtaa

SEQ ID NO: 1528 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aggcagtttttaatgtcaatgta

SEQ ID NO: 1529 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agggcagtttttaatgtcaatgt

SEQ ID NO: 1530 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atgggcagtttttaatgtcaatg

SEQ ID NO: 1531 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
atgcagcaatgaagtattcccac

SEQ ID NO: 1532 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
agtgcatagtcccaaatgacttc

SEQ ID NO: 1533 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atattacaggtgcatagtcccaa

SEQ ID NO: 1534 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aattcgctggtattacaggtgca

SEQ ID NO: 1535 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
accatattcgctggtattacagg

SEQ ID NO: 1536 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atccatattcgctggtattacag

SEQ ID NO: 1537 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
attatccaaatgctgagacctgt

SEQ ID NO: 1538 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atcgtactgtgtgtacataactt

SEQ ID NO: 1539 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
attcgtactgtgtgtacataact

SEQ ID NO: 1540 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atcttcgtactgtgtgtacataa

SEQ ID NO: 1541 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aatcttcgtactgtgtgtacata

SEQ ID NO: 1542 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acatcttcgtactgtgtgtacat

SEQ ID NO: 1543 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agaaggactcatcttcgtactgt

SEQ ID NO: 1544 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atgaaggactcatcttcgtactg

SEQ ID NO: 1545 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atctttcatattgggattcactg

SEQ ID NO: 1546 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agaaggtcactccatgagggtaa

SEQ ID NO: 1547 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
actctgatcatggtgttgttcct

SEQ ID NO: 1548 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
actgctctgatcatggtgttgtt

SEQ ID NO: 1549 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agaactgctctgatcatggtgtt

SEQ ID NO: 1550 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agttgaactgctctgatcatggt

SEQ ID NO: 1551 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atggttgaactgctctgatcatg

SEQ ID NO: 1552 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
accacttataagtataggtttcc

SEQ ID NO: 1553 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
atccacttataagtataggtttc

SEQ ID NO: 1554 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
ataagatgttccacttataagta

SEQ ID NO: 1555 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
aatctgctcttacagattagaag

SEQ ID NO: 1556 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
agggatctgctcttacagattag

SEQ ID NO: 1557 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
agttgatgttgtcctcaaggtac

SEQ ID NO: 1558 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agctcatgatgtttgattcataa

SEQ ID NO: 1559 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agtgctcatgatgtttgattcat

SEQ ID NO: 1560 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
aatagccattgatagtgctcatg

SEQ ID NO: 1561 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aagtgtcatcaaagcagaatcca

SEQ ID NO: 1562 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acactacagaagtgccactggac

SEQ ID NO: 1563 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acacactacagaagtgccactgg

SEQ ID NO: 1564 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatagatgaatgagtgcccagtg

SEQ ID NO: 1565 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
attatccattgtgaccgtcacag

SEQ ID NO: 1566 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agaagttaacatccaagttccaa

SEQ ID NO: 1567 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actagaattcatggaagttaaca

SEQ ID NO: 1568 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
aatatgagtcttcatcatcatct

SEQ ID NO: 1569 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atctcatatgagtcttcatcatc

SEQ ID NO: 1570 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acctgattcaatgatgagtttcg

SEQ ID NO: 1571 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acaacaattatatctgtgtttga

SEQ ID NO: 1572 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaccaacaattatatctgtgtt

SEQ ID NO: 1573 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atatagggtcttcagaatatggg

SEQ ID NO: 1574 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actctatagggtcttcagaatat

SEQ ID NO: 1575 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agcaccaagtgaaagtagacgta

SEQ ID NO: 1576 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
attatgtgctagtaatttcatcc

SEQ ID NO: 1577 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaactttatgtgctagtaatttc

SEQ ID NO: 1578 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acccaactttatgtgctagtaat

SEQ ID NO: 1579 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acagaagccaaatgccatctccc

SEQ ID NO: 1580 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
attggattatttcatagctacct

SEQ ID NO: 1581 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agtgtcttcatcagtatcttgga

SEQ ID NO: 1582 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agctgtgtcttcatcagtatctt

SEQ ID NO: 1583 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aattgttaacagctgtgtcttca

SEQ ID NO: 1584 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atgtctaactctaggaaactttg

SEQ ID NO: 1585 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agatttatgtctaactctaggaa

SEQ ID NO: 1586 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atccatcctgtcttacttgtaga

SEQ ID NO: 1587 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
attcgtgtcttaatgagaaactg

SEQ ID NO: 1588 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
aggagataaaggagcatggtgtg

SEQ ID NO: 1589 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acttagagggtgaaaggtcctcg

SEQ ID NO: 1590 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atcattggatttatgaagcacca

SEQ ID NO: 1591 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
attcattggatttatgaagcacc

SEQ ID NO: 1592 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agggaagagatgtttcattggat

SEQ ID NO: 1593 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atctgattatggtcaggaagtga

SEQ ID NO: 1594 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atcggtcatactcaagcatttca

SEQ ID NO: 1595 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agacttcggtcatactcaagcat

SEQ ID NO: 1596 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
attgtgacttcggtcatactcaa

SEQ ID NO: 1597 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agacttgtgacttcggtcatact

SEQ ID NO: 1598 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aaggacttgtgacttcggtcata

SEQ ID NO: 1599 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaggacttgtgacttcggtcat

SEQ ID NO: 1600 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agaaggacttgtgacttcggtca

SEQ ID NO: 1601 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agtctgactgagttctggagaga

SEQ ID NO: 1602 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atgtctgactgagttctggagag

SEQ ID NO: 1603 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agagagaggtttgtctggctgaa

SEQ ID NO: 1604 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actagattcagaagggtagaata

SEQ ID NO: 1605 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatcattgagagtaggagatgaa

SEQ ID NO: 1606 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
agtggattaaattcctttgatag

SEQ ID NO: 1607 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
aaccagtggattaaattcctttg

SEQ ID NO: 1608 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aactataaccagtggattaaatt

SEQ ID NO: 1609 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acactataaccagtggattaaat

SEQ ID NO: 1610 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
acaatgtaatctgtaccatcttt

SEQ ID NO: 1611 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actcaatgtaatctgtaccatct

SEQ ID NO: 1612 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatgtttgtcctaacatcagttt

SEQ ID NO: 1613 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agatgtttgtcctaacatcagtt

SEQ ID NO: 1614 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
ataatcccaggatatttcttcag

SEQ ID NO: 1615 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agaatatcatcagagtcttcaat

SEQ ID NO: 1616 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
attccgagatgctcttcatactc

SEQ ID NO: 1617 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acaagaattccgagatgctcttc

SEQ ID NO: 1618 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aaataggaccaagaattccgaga

SEQ ID NO: 1619 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
ataataggaccaagaattccgag

SEQ ID NO: 1620 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atgataataggaccaagaattcc

SEQ ID NO: 1621 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
actctgataataggaccaagaat

SEQ ID NO: 1622 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
attcagctctgataataggacca

SEQ ID NO: 1623 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggataacatcatccacttcagc

SEQ ID NO: 1624 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atggataacatcatccacttcag

SEQ ID NO: 1625 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acataagtctttccctctgatga

SEQ ID NO: 1626 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
aatcttcataagtctttccctct

SEQ ID NO: 1627 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggtataactgctatttggctga

SEQ ID NO: 1628 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acatacgtaggtataactgctat

SEQ ID NO: 1629 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
aatcaagcctgagtgaatatctt

SEQ ID NO: 1630 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
actgtccttatgtagtattcctt

SEQ ID NO: 1631 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aatgttgctgtccttatgtagta

SEQ ID NO: 1632 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
agcatgttgctgtccttatgtag

SEQ ID NO: 1633 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ataagacaaattctctcatgtcc

SEQ ID NO: 1634 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
agtaagacaaattctctcatgtc

SEQ ID NO: 1635 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatagtaagacaaattctctcat

SEQ ID NO: 1636 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
atcttcttttcatcaaaggtcat

SEQ ID NO: 1637 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
actcttcttttcatcaaaggtca

SEQ ID NO: 1638 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
agctcttcttttcatcaaaggtc

SEQ ID NO: 1639 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
aagctcttcttttcatcaaaggt

SEQ ID NO: 1640 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
acagctcttcttttcatcaaagg

SEQ ID NO: 1641 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
accagctcttcttttcatcaaag

SEQ ID NO: 1642 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aaccagctcttcttttcatcaaa

SEQ ID NO: 1643 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
ataccagctcttcttttcatcaa

SEQ ID NO: 1644 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agtaccagctcttcttttcatca

SEQ ID NO: 1645 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
aagtaccagctcttcttttcatc

SEQ ID NO: 1646 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atagtaccagctcttcttttcat

SEQ ID NO: 1647 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aatagtaccagctcttcttttca

SEQ ID NO: 1648 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acatagtaccagctcttcttttc

SEQ ID NO: 1649 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
atcatagtaccagctcttctttt

SEQ ID NO: 1650 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
attcatagtaccagctcttcttt

SEQ ID NO: 1651 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
atttcatagtaccagctcttctt

SEQ ID NO: 1652 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
attttcatagtaccagctcttct

SEQ ID NO: 1653 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
acttttcatagtaccagctcttc

SEQ ID NO: 1654 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atcttttcatagtaccagctctt

SEQ ID NO: 1655 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
attcttttcatagtaccagctct

SEQ ID NO: 1656 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acttcttttcatagtaccagctc

SEQ ID NO: 1657 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
aacttcttttcatagtaccagct

SEQ ID NO: 1658 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atgagtctccaagaacttcggga

SEQ ID NO: 1659 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
atgtgagtctccaagaacttcgg

SEQ ID NO: 1660 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatcccattaatggcgtgaaact

SEQ ID NO: 1661 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actgtagatcatcccattaatgg

SEQ ID NO: 1662 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acacgtgaatgtcttgggagccg

SEQ ID NO: 1663 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agaaccacgtgaatgtcttggga

SEQ ID NO: 1664 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
atgaaagtgaaccacgtgaatgt

SEQ ID NO: 1665 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aataagaaatggcgtttgcatcc

SEQ ID NO: 1666 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atgataagaaatggcgtttgcat

SEQ ID NO: 1667 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aagtctctgtccatgataagaaa

SEQ ID NO: 1668 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aacagtctctgtccatgataaga

SEQ ID NO: 1669 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagatatgataccagtgcttagt

SEQ ID NO: 1670 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
agatctgtgaatcagatatgata

SEQ ID NO: 1671 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
attgatctgtgaatcagatatga

SEQ ID NO: 1672 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
aataagatccaccattgtttaat

SEQ ID NO: 1673 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atataagatccaccattgtttaa

SEQ ID NO: 1674 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acattataagatccaccattgtt

SEQ ID NO: 1675 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acaagcattataagatccaccat

SEQ ID NO: 1676 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acactccaagcattataagatcc

SEQ ID NO: 1677 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
aaggtagtgtttggcaccttggg

SEQ ID NO: 1678 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
agaactctgtggtatagcaggac

SEQ ID NO: 1679 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aagaactctgtggtatagcagga

SEQ ID NO: 1680 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aacatagaactctgtggtatagc

SEQ ID NO: 1681 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actacatagaactctgtggtata

SEQ ID NO: 1682 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aagctacatagaactctgtggta

SEQ ID NO: 1683 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaagctacatagaactctgtggt

SEQ ID NO: 1684 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
atgtaagctacatagaactctgt

SEQ ID NO: 1685 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aactgtaagctacatagaactct

SEQ ID NO: 1686 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
aggaactgtaagctacatagaac

SEQ ID NO: 1687 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
attgtagaggcatctgaattgcc

SEQ ID NO: 1688 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
aattgtagaggcatctgaattgc

SEQ ID NO: 1689 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
attattgtagaggcatctgaatt

SEQ ID NO: 1690 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
aaataggtgggtcaaactgattc

SEQ ID NO: 1691 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acaataggtgggtcaaactgatt

SEQ ID NO: 1692 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aacaataggtgggtcaaactgat

SEQ ID NO: 1693 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaatatatctagccacaataggt

SEQ ID NO: 1694 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
aagatcctaatatatctagccac

SEQ ID NO: 1695 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atggagagatcctaatatatcta

SEQ ID NO: 1696 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acgaagaagctgtgatttgcttg

SEQ ID NO: 1697 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
atagatcaatttctagccactgc

SEQ ID NO: 1698 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agatcttgagtagatcaatttct

SEQ ID NO: 1699 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
attgatcttgagtagatcaattt

SEQ ID NO: 1700 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aatagctctttacatacatttca

SEQ ID NO: 1701 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
agatggtatagctctttacatac

SEQ ID NO: 1702 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atagtggatggtatagctcttta

SEQ ID NO: 1703 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aaaatcttgtccaccatggagga

SEQ ID NO: 1704 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaaatcttgtccaccatggagg

SEQ ID NO: 1705 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaaaatcttgtccaccatggag

SEQ ID NO: 1706 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acaaaaatcttgtccaccatgga

SEQ ID NO: 1707 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atcaaaaatcttgtccaccatgg

SEQ ID NO: 1708 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
attcaaaaatcttgtccaccatg

SEQ ID NO: 1709 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acttcaaaaatcttgtccaccat

SEQ ID NO: 1710 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
accttcaaaaatcttgtccacca

SEQ ID NO: 1711 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
atccttcaaaaatcttgtccacc

SEQ ID NO: 1712 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
attccttcaaaaatcttgtccac

SEQ ID NO: 1713 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
atttccttcaaaaatcttgtcca

SEQ ID NO: 1714 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
aatttccttcaaaaatcttgtcc

SEQ ID NO: 1715 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
atatttccttcaaaaatcttgtc

SEQ ID NO: 1716 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agtatttccttcaaaaatcttgt

SEQ ID NO: 1717 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagtatttccttcaaaaatcttg

SEQ ID NO: 1718 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atagtatttccttcaaaaatctt

SEQ ID NO: 1719 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
attagtatttccttcaaaaatct

SEQ ID NO: 1720 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
aattagtatttccttcaaaaatc

SEQ ID NO: 1721 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
atattagtatttccttcaaaaat

SEQ ID NO: 1722 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtattagtatttccttcaaaaa

SEQ ID NO: 1723 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggtattagtatttccttcaaaa

SEQ ID NO: 1724 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
aacatgtcctttggtattagtat

SEQ ID NO: 1725 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acacatgtcctttggtattagta

SEQ ID NO: 1726 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atcacatgtcctttggtattagt

SEQ ID NO: 1727 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agataaacctggaaatgattggg

SEQ ID NO: 1728 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acggataaacctggaaatgattg

SEQ ID NO: 1729 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
agtgcaatactttgattccatgt

SEQ ID NO: 1730 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
aacagccaaagagttccaggcga

SEQ ID NO: 1731 - RNA, 23 nt, synthetic construct
  source 1..23: mol_type = other RNA
cacagctaaggcagttctacgtg

SEQ ID NO: 1732 - RNA, 23 nt, synthetic construct
  source 1..23: mol_type = other RNA
tcagggcatcagttggagctacc

SEQ ID NO: 1733 - RNA, 23 nt, synthetic construct
  source 1..23: mol_type = other RNA
tgtctacagagagtatgaaccat

SEQ ID NO: 1734 - RNA, 23 nt, synthetic construct
  source 1..23: mol_type = other RNA
tctacagagagtatgaaccatat

SEQ ID NO: 1735 - RNA, 23 nt, synthetic construct
  source 1..23: mol_type = other RNA
ctacagagagtatgaaccatatt

SEQ ID NO: 1736 - RNA, 23 nt, synthetic construct
  source 1..23: mol_type = other RNA
acttcttgggcctactttatatg

SEQ ID NO: 1737 - RNA, 23 nt, synthetic construct
  source 1..23: mol_type = other RNA
cctactttatatgctgaagtcgg

SEQ ID NO: 1738 - RNA, 23 nt, synthetic construct
  source 1..23: mol_type = other RNA
ctactttatatgctgaagtcgga

SEQ ID NO: 1739 - RNA, 23 nt, synthetic construct
  source 1..23: mol_type = other RNA
acagtaaattatcagaaggtgct

SEQ ID NO: 1740 - RNA, 23 nt, synthetic construct
  source 1..23: mol_type = other RNA
gtaaattatcagaaggtgcttct

SEQ ID NO: 1741 - RNA, 23 nt, synthetic construct
  source 1..23: mol_type = other RNA
ttatcagaaggtgcttcttacct

SEQ ID NO: 1742 - RNA, 23 nt, synthetic construct
  source 1..23: mol_type = other RNA
tatcagaaggtgcttcttacctt

SEQ ID NO: 1743 - RNA, 23 nt, synthetic construct
  source 1..23: mol_type = other RNA
atcagaaggtgcttcttaccttg

SEQ ID NO: 1744 - RNA, 23 nt, synthetic construct
  source 1..23: mol_type = other RNA
gaatacacctatgaatggagtat

SEQ ID NO: 1745 - RNA, 23 nt, synthetic construct
  source 1..23: mol_type = other RNA
acacctatgaatggagtatcagt

SEQ ID NO: 1746 - RNA, 23 nt, synthetic construct
  source 1..23: mol_type = other RNA
cacctatgaatggagtatcagtg

SEQ ID NO: 1747 - RNA, 23 nt, synthetic construct
  source 1..23: mol_type = other RNA
ctatgaatggagtatcagtgagg

SEQ ID NO: 1748 - RNA, 23 nt, synthetic construct
  source 1..23: mol_type = other RNA
ccatgcctcacacacatctatta

SEQ ID NO: 1749 - RNA, 23 nt, synthetic construct
  source 1..23: mol_type = other RNA
catgcctcacacacatctattac

SEQ ID NO: 1750 - RNA, 23 nt, synthetic construct
  source 1..23: mol_type = other RNA
atgcctcacacacatctattact

SEQ ID NO: 1751 - RNA, 23 nt, synthetic construct
  source 1..23: mol_type = other RNA
tgcctcacacacatctattactc

SEQ ID NO: 1752 - RNA, 23 nt, synthetic construct
  source 1..23: mol_type = other RNA
gcctcacacacatctattactcc

SEQ ID NO: 1753 - RNA, 23 nt, synthetic construct
  source 1..23: mol_type = other RNA
ctcacacacatctattactccca

SEQ ID NO: 1754 - RNA, 23 nt, synthetic construct
  source 1..23: mol_type = other RNA
acacatctattactcccatgaaa

SEQ ID NO: 1755 - RNA, 23 nt, synthetic construct
  source 1..23: mol_type = other RNA
cagaagacgtttgacaagcaaat

SEQ ID NO: 1756 - RNA, 23 nt, synthetic construct
  source 1..23: mol_type = other RNA
gaagacgtttgacaagcaaatcg

SEQ ID NO: 1757 - RNA, 23 nt, synthetic construct
  source 1..23: mol_type = other RNA
aagacgtttgacaagcaaatcgt

SEQ ID NO: 1758 - RNA, 23 nt, synthetic construct
  source 1..23: mol_type = other RNA
gagccagtcatcatccctaatgt

SEQ ID NO: 1759 - RNA, 23 nt, synthetic construct
  source 1..23: mol_type = other RNA
cagtcatcatccctaatgtacac

SEQ ID NO: 1760 - RNA, 23 nt, synthetic construct
  source 1..23: mol_type = other RNA
gtcatcatccctaatgtacacag

SEQ ID NO: 1761 - RNA, 23 nt, synthetic construct
  source 1..23: mol_type = other RNA
tcatcatccctaatgtacacagt

SEQ ID NO: 1762 - RNA, 23 nt, synthetic construct
  source 1..23: mol_type = other RNA
ctaatgtacacagtcaatggata

SEQ ID NO: 1763 - RNA, 23 nt, synthetic construct
  source 1..23: mol_type = other RNA
taatgtacacagtcaatggatat

SEQ ID NO: 1764 - RNA, 23 nt, synthetic construct
  source 1..23: mol_type = other RNA
atatgtgaatgggacaatgccag

SEQ ID NO: 1765 - RNA, 23 nt, synthetic construct
  source 1..23: mol_type = other RNA
atgccagatataacagtttgtgc

SEQ ID NO: 1766 - RNA, 23 nt, synthetic construct
  source 1..23: mol_type = other RNA
tgccagatataacagtttgtgcc

SEQ ID NO: 1767 - RNA, 23 nt, synthetic construct
  source 1..23: mol_type = other RNA
tggagcagaaccatcataaggtc

SEQ ID NO: 1768 - RNA, 23 nt, synthetic construct
  source 1..23: mol_type = other RNA
agcagaaccatcataaggtctca

SEQ ID NO: 1769 - RNA, 23 nt, synthetic construct
  source 1..23: mol_type = other RNA
gcagaaccatcataaggtctcag

SEQ ID NO: 1770 - RNA, 23 nt, synthetic construct
  source 1..23: mol_type = other RNA
ccatcacccttgtcagtgctaca

SEQ ID NO: 1771 - RNA, 23 nt, synthetic construct
  source 1..23: mol_type = other RNA
ccttgtcagtgctacatccacta

SEQ ID NO: 1772 - RNA, 23 nt, synthetic construct
  source 1..23: mol_type = other RNA
tacatccactaccgcaaatatga

SEQ ID NO: 1773 - RNA, 23 nt, synthetic construct
  source 1..23: mol_type = other RNA
gcaagctgggatgcaggcttaca

SEQ ID NO: 1774 - RNA, 23 nt, synthetic construct
  source 1..23: mol_type = other RNA
caagctgggatgcaggcttacat

SEQ ID NO: 1775 - RNA, 23 nt, synthetic construct
  source 1..23: mol_type = other RNA
aagctgggatgcaggcttacatt

SEQ ID NO: 1776 - RNA, 23 nt, synthetic construct
  source 1..23: mol_type = other RNA
agctgggatgcaggcttacattg

SEQ ID NO: 1777 - RNA, 23 nt, synthetic construct
  source 1..23: mol_type = other RNA
gctgggatgcaggcttacattga

SEQ ID NO: 1778 - RNA, 23 nt, synthetic construct
  source 1..23: mol_type = other RNA
ctgggatgcaggcttacattgac

SEQ ID NO: 1779 - RNA, 23 nt, synthetic construct
  source 1..23: mol_type = other RNA
tgggatgcaggcttacattgaca

SEQ ID NO: 1780 - RNA, 23 nt, synthetic construct
  source 1..23: mol_type = other RNA
gggatgcaggcttacattgacat

SEQ ID NO: 1781 - RNA, 23 nt, synthetic construct
  source 1..23: mol_type = other RNA
ggatgcaggcttacattgacatt

SEQ ID NO: 1782 - RNA, 23 nt, synthetic construct
  source 1..23: mol_type = other RNA
gatgcaggcttacattgacatta

SEQ ID NO: 1783 - RNA, 23 nt, synthetic construct
  source 1..23: mol_type = other RNA
atgcaggcttacattgacattaa

SEQ ID NO: 1784 - RNA, 23 nt, synthetic construct
  source 1..23: mol_type = other RNA
gcaggcttacattgacattaaaa

SEQ ID NO: 1785 - RNA, 23 nt, synthetic construct
  source 1..23: mol_type = other RNA
caggcttacattgacattaaaaa

SEQ ID NO: 1786 - RNA, 23 nt, synthetic construct
  source 1..23: mol_type = other RNA
aggcttacattgacattaaaaac

SEQ ID NO: 1787 - RNA, 23 nt, synthetic construct
  source 1..23: mol_type = other RNA
ggcttacattgacattaaaaact

SEQ ID NO: 1788 - RNA, 23 nt, synthetic construct
  source 1..23: mol_type = other RNA
gcttacattgacattaaaaactg

SEQ ID NO: 1789 - RNA, 23 nt, synthetic construct
  source 1..23: mol_type = other RNA
cttacattgacattaaaaactgc

SEQ ID NO: 1790 - RNA, 23 nt, synthetic construct
  source 1..23: mol_type = other RNA
ttacattgacattaaaaactgcc

SEQ ID NO: 1791 - RNA, 23 nt, synthetic construct
  source 1..23: mol_type = other RNA
tacattgacattaaaaactgccc

SEQ ID NO: 1792 - RNA, 23 nt, synthetic construct
  source 1..23: mol_type = other RNA
acattgacattaaaaactgccca

SEQ ID NO: 1793 - RNA, 23 nt, synthetic construct
  source 1..23: mol_type = other RNA
cattgacattaaaaactgcccaa

SEQ ID NO: 1794 - RNA, 23 nt, synthetic construct
  source 1..23: mol_type = other RNA
gtgggaatacttcattgctgcag

SEQ ID NO: 1795 - RNA, 23 nt, synthetic construct
  source 1..23: mol_type = other RNA
gaagtcatttgggactatgcacc

SEQ ID NO: 1796 - RNA, 23 nt, synthetic construct
  source 1..23: mol_type = other RNA
ttgggactatgcacctgtaatac

SEQ ID NO: 1797 - RNA, 23 nt, synthetic construct
  source 1..23: mol_type = other RNA
tgcacctgtaataccagcgaata

SEQ ID NO: 1798 - RNA, 23 nt, synthetic construct
  source 1..23: mol_type = other RNA
cctgtaataccagcgaatatgga

SEQ ID NO: 1799 - RNA, 23 nt, synthetic construct
  source 1..23: mol_type = other RNA
ctgtaataccagcgaatatggac

SEQ ID NO: 1800 - RNA, 23 nt, synthetic construct
  source 1..23: mol_type = other RNA
acaggtctcagcatttggataat

SEQ ID NO: 1801 - RNA, 23 nt, synthetic construct
  source 1..23: mol_type = other RNA
aagttatgtacacacagtacgaa

SEQ ID NO: 1802 - RNA, 23 nt, synthetic construct
  source 1..23: mol_type = other RNA
agttatgtacacacagtacgaag

SEQ ID NO: 1803 - RNA, 23 nt, synthetic construct
  source 1..23: mol_type = other RNA
ttatgtacacacagtacgaagat

SEQ ID NO: 1804 - RNA, 23 nt, synthetic construct
  source 1..23: mol_type = other RNA
tatgtacacacagtacgaagatg

SEQ ID NO: 1805 - RNA, 23 nt, synthetic construct
  source 1..23: mol_type = other RNA
atgtacacacagtacgaagatga

SEQ ID NO: 1806 - RNA, 23 nt, synthetic construct
  source 1..23: mol_type = other RNA
acagtacgaagatgagtccttca

SEQ ID NO: 1807 - RNA, 23 nt, synthetic construct
  source 1..23: mol_type = other RNA
cagtacgaagatgagtccttcac

SEQ ID NO: 1808 - RNA, 23 nt, synthetic construct
  source 1..23: mol_type = other RNA
cagtgaatcccaatatgaaagaa

SEQ ID NO: 1809 - RNA, 23 nt, synthetic construct
  source 1..23: mol_type = other RNA
ttaccctcatggagtgaccttct

SEQ ID NO: 1810 - RNA, 23 nt, synthetic construct
  source 1..23: mol_type = other RNA
aggaacaacaccatgatcagagc

SEQ ID NO: 1811 - RNA, 23 nt, synthetic construct
  source 1..23: mol_type = other RNA
aacaacaccatgatcagagcagt

SEQ ID NO: 1812 - RNA, 23 nt, synthetic construct
  source 1..23: mol_type = other RNA
aacaccatgatcagagcagttca

SEQ ID NO: 1813 - RNA, 23 nt, synthetic construct
  source 1..23: mol_type = other RNA
accatgatcagagcagttcaacc

SEQ ID NO: 1814 - RNA, 23 nt, synthetic construct
  source 1..23: mol_type = other RNA
catgatcagagcagttcaaccag

SEQ ID NO: 1815 - RNA, 23 nt, synthetic construct
  source 1..23: mol_type = other RNA
ggaaacctatacttataagtgga

SEQ ID NO: 1816 - RNA, 23 nt, synthetic construct
  source 1..23: mol_type = other RNA
gaaacctatacttataagtggaa

SEQ ID NO: 1817 - RNA, 23 nt, synthetic construct
  source 1..23: mol_type = other RNA
tacttataagtggaacatcttag

SEQ ID NO: 1818 - RNA, 23 nt, synthetic construct
  source 1..23: mol_type = other RNA
cttctaatctgtaagagcagatc

SEQ ID NO: 1819 - RNA, 23 nt, synthetic construct
  source 1..23: mol_type = other RNA
ctaatctgtaagagcagatccct

SEQ ID NO: 1820 - RNA, 23 nt, synthetic construct
  source 1..23: mol_type = other RNA
gtaccttgaggacaacatcaaca

SEQ ID NO: 1821 - RNA, 23 nt, synthetic construct
  source 1..23: mol_type = other RNA
ttatgaatcaaacatcatgagca

SEQ ID NO: 1822 - RNA, 23 nt, synthetic construct
  source 1..23: mol_type = other RNA
atgaatcaaacatcatgagcact

SEQ ID NO: 1823 - RNA, 23 nt, synthetic construct
  source 1..23: mol_type = other RNA
catgagcactatcaatggctatg

SEQ ID NO: 1824 - RNA, 23 nt, synthetic construct
  source 1..23: mol_type = other RNA
tggattctgctttgatgacactg

SEQ ID NO: 1825 - RNA, 23 nt, synthetic construct
  source 1..23: mol_type = other RNA
gtccagtggcacttctgtagtgt

SEQ ID NO: 1826 - RNA, 23 nt, synthetic construct
  source 1..23: mol_type = other RNA
ccagtggcacttctgtagtgtgg

SEQ ID NO: 1827 - RNA, 23 nt, synthetic construct
  source 1..23: mol_type = other RNA
cactgggcactcattcatctatg

SEQ ID NO: 1828 - RNA, 23 nt, synthetic construct
  source 1..23: mol_type = other RNA
ctgtgacggtcacaatggataat

SEQ ID NO: 1829 - RNA, 23 nt, synthetic construct
  source 1..23: mol_type = other RNA
ttggaacttggatgttaacttcc

SEQ ID NO: 1830 - RNA, 23 nt, synthetic construct
  source 1..23: mol_type = other RNA
tgttaacttccatgaattctagt

SEQ ID NO: 1831 - RNA, 23 nt, synthetic construct
  source 1..23: mol_type = other RNA
agatgatgatgaagactcatatg

SEQ ID NO: 1832 - RNA, 23 nt, synthetic construct
  source 1..23: mol_type = other RNA
gatgatgaagactcatatgagat

SEQ ID NO: 1833 - RNA, 23 nt, synthetic construct
  source 1..23: mol_type = other RNA
cgaaactcatcattgaatcagga

SEQ ID NO: 1834 - RNA, 23 nt, synthetic construct
  source 1..23: mol_type = other RNA
tcaaacacagatataattgttgg

SEQ ID NO: 1835 - RNA, 23 nt, synthetic construct
  source 1..23: mol_type = other RNA
aacacagatataattgttggttc

SEQ ID NO: 1836 - RNA, 23 nt, synthetic construct
  source 1..23: mol_type = other RNA
cccatattctgaagaccctatag

SEQ ID NO: 1837 - RNA, 23 nt, synthetic construct
  source 1..23: mol_type = other RNA
atattctgaagaccctatagagg

SEQ ID NO: 1838 - RNA, 23 nt, synthetic construct
  source 1..23: mol_type = other RNA
tacgtctactttcacttggtgct

SEQ ID NO: 1839 - RNA, 23 nt, synthetic construct
  source 1..23: mol_type = other RNA
ggatgaaattactagcacataaa

SEQ ID NO: 1840 - RNA, 23 nt, synthetic construct
  source 1..23: mol_type = other RNA
gaaattactagcacataaagttg

SEQ ID NO: 1841 - RNA, 23 nt, synthetic construct
  source 1..23: mol_type = other RNA
attactagcacataaagttggga

SEQ ID NO: 1842 - RNA, 23 nt, synthetic construct
  source 1..23: mol_type = other RNA
gggagatggcatttggcttctga

SEQ ID NO: 1843 - RNA, 23 nt, synthetic construct
  source 1..23: mol_type = other RNA
aggtagctatgaaataatccaag

SEQ ID NO: 1844 - RNA, 23 nt, synthetic construct
  source 1..23: mol_type = other RNA
tccaagatactgatgaagacaca

SEQ ID NO: 1845 - RNA, 23 nt, synthetic construct
  source 1..23: mol_type = other RNA
aagatactgatgaagacacagct

SEQ ID NO: 1846 - RNA, 23 nt, synthetic construct
  source 1..23: mol_type = other RNA
tgaagacacagctgttaacaatt

SEQ ID NO: 1847 - RNA, 23 nt, synthetic construct
  source 1..23: mol_type = other RNA
caaagtttcctagagttagacat

SEQ ID NO: 1848 - RNA, 23 nt, synthetic construct
  source 1..23: mol_type = other RNA
ttcctagagttagacataaatct

SEQ ID NO: 1849 - RNA, 23 nt, synthetic construct
  source 1..23: mol_type = other RNA
tctacaagtaagacaggatggag

SEQ ID NO: 1850 - RNA, 23 nt, synthetic construct
  source 1..23: mol_type = other RNA
cagtttctcattaagacacgaaa

SEQ ID NO: 1851 - RNA, 23 nt, synthetic construct
  source 1..23: mol_type = other RNA
cacaccatgctcctttatctccg

SEQ ID NO: 1852 - RNA, 23 nt, synthetic construct
  source 1..23: mol_type = other RNA
cgaggacctttcaccctctaaga

SEQ ID NO: 1853 - RNA, 23 nt, synthetic construct
  source 1..23: mol_type = other RNA
tggtgcttcataaatccaatgaa

SEQ ID NO: 1854 - RNA, 23 nt, synthetic construct
  source 1..23: mol_type = other RNA
ggtgcttcataaatccaatgaaa

SEQ ID NO: 1855 - RNA, 23 nt, synthetic construct
  source 1..23: mol_type = other RNA
atccaatgaaacatctcttccca

SEQ ID NO: 1856 - RNA, 23 nt, synthetic construct
  source 1..23: mol_type = other RNA
tcacttcctgaccataatcagaa

SEQ ID NO: 1857 - RNA, 23 nt, synthetic construct
  source 1..23: mol_type = other RNA
tgaaatgcttgagtatgaccgaa

SEQ ID NO: 1858 - RNA, 23 nt, synthetic construct
  source 1..23: mol_type = other RNA
atgcttgagtatgaccgaagtca

SEQ ID NO: 1859 - RNA, 23 nt, synthetic construct
  source 1..23: mol_type = other RNA
ttgagtatgaccgaagtcacaag

SEQ ID NO: 1860 - RNA, 23 nt, synthetic construct
  source 1..23: mol_type = other RNA
agtatgaccgaagtcacaagtcc

SEQ ID NO: 1861 - RNA, 23 nt, synthetic construct
  source 1..23: mol_type = other RNA
tatgaccgaagtcacaagtcctt

SEQ ID NO: 1862 - RNA, 23 nt, synthetic construct
  source 1..23: mol_type = other RNA
atgaccgaagtcacaagtccttc

SEQ ID NO: 1863 - RNA, 23 nt, synthetic construct
  source 1..23: mol_type = other RNA
tgaccgaagtcacaagtccttcc

SEQ ID NO: 1864 - RNA, 23 nt, synthetic construct
  source 1..23: mol_type = other RNA
tctctccagaactcagtcagaca

SEQ ID NO: 1865 - RNA, 23 nt, synthetic construct
  source 1..23: mol_type = other RNA
ctctccagaactcagtcagacaa

SEQ ID NO: 1866 - RNA, 23 nt, synthetic construct
  source 1..23: mol_type = other RNA
ctcagccagacaaacctctctcc

SEQ ID NO: 1867 - RNA, 23 nt, synthetic construct
  source 1..23: mol_type = other RNA
tattctacccttctgaatctagt

SEQ ID NO: 1868 - RNA, 23 nt, synthetic construct
  source 1..23: mol_type = other RNA
ttcatctcctactctcaatgata

SEQ ID NO: 1869 - RNA, 23 nt, synthetic construct
  source 1..23: mol_type = other RNA
ctatcaaaggaatttaatccact

SEQ ID NO: 1870 - RNA, 23 nt, synthetic construct
  source 1..23: mol_type = other RNA
caaaggaatttaatccactggtt

SEQ ID NO: 1871 - RNA, 23 nt, synthetic construct
  source 1..23: mol_type = other RNA
aatttaatccactggttatagtg

SEQ ID NO: 1872 - RNA, 23 nt, synthetic construct
  source 1..23: mol_type = other RNA
atttaatccactggttatagtgg

SEQ ID NO: 1873 - RNA, 23 nt, synthetic construct
  source 1..23: mol_type = other RNA
aaagatggtacagattacattga

SEQ ID NO: 1874 - RNA, 23 nt, synthetic construct
  source 1..23: mol_type = other RNA
agatggtacagattacattgaga

SEQ ID NO: 1875 - RNA, 23 nt, synthetic construct
  source 1..23: mol_type = other RNA
aaactgatgttaggacaaacatc

SEQ ID NO: 1876 - RNA, 23 nt, synthetic construct
  source 1..23: mol_type = other RNA
aactgatgttaggacaaacatca

SEQ ID NO: 1877 - RNA, 23 nt, synthetic construct
  source 1..23: mol_type = other RNA
ctgaagaaatatcctgggattat

SEQ ID NO: 1878 - RNA, 23 nt, synthetic construct
  source 1..23: mol_type = other RNA
attgaagactctgatgatattcc

SEQ ID NO: 1879 - RNA, 23 nt, synthetic construct
  source 1..23: mol_type = other RNA
gagtatgaagagcatctcggaat

SEQ ID NO: 1880 - RNA, 23 nt, synthetic construct
  source 1..23: mol_type = other RNA
gaagagcatctcggaattcttgg

SEQ ID NO: 1881 - RNA, 23 nt, synthetic construct
  source 1..23: mol_type = other RNA
ctcggaattcttggtcctattat

SEQ ID NO: 1882 - RNA, 23 nt, synthetic construct
  source 1..23: mol_type = other RNA
ggaattcttggtcctattatcag

SEQ ID NO: 1883 - RNA, 23 nt, synthetic construct
  source 1..23: mol_type = other RNA
attcttggtcctattatcagagc

SEQ ID NO: 1884 - RNA, 23 nt, synthetic construct
  source 1..23: mol_type = other RNA
tggtcctattatcagagctgaag

SEQ ID NO: 1885 - RNA, 23 nt, synthetic construct
  source 1..23: mol_type = other RNA
gctgaagtggatgatgttatcca

SEQ ID NO: 1886 - RNA, 23 nt, synthetic construct
  source 1..23: mol_type = other RNA
ctgaagtggatgatgttatccaa

SEQ ID NO: 1887 - RNA, 23 nt, synthetic construct
  source 1..23: mol_type = other RNA
tcatcagagggaaagacttatga

SEQ ID NO: 1888 - RNA, 23 nt, synthetic construct
  source 1..23: mol_type = other RNA
agagggaaagacttatgaagatg

SEQ ID NO: 1889 - RNA, 23 nt, synthetic construct
  source 1..23: mol_type = other RNA
tcagccaaatagcagttatacct

SEQ ID NO: 1890 - RNA, 23 nt, synthetic construct
  source 1..23: mol_type = other RNA
atagcagttatacctacgtatgg

SEQ ID NO: 1891 - RNA, 23 nt, synthetic construct
  source 1..23: mol_type = other RNA
aagatattcactcaggcttgata

SEQ ID NO: 1892 - RNA, 23 nt, synthetic construct
  source 1..23: mol_type = other RNA
aaggaatactacataaggacagc

SEQ ID NO: 1893 - RNA, 23 nt, synthetic construct
  source 1..23: mol_type = other RNA
tactacataaggacagcaacatg

SEQ ID NO: 1894 - RNA, 23 nt, synthetic construct
  source 1..23: mol_type = other RNA
ctacataaggacagcaacatgcc

SEQ ID NO: 1895 - RNA, 23 nt, synthetic construct
  source 1..23: mol_type = other RNA
ggacatgagagaatttgtcttac

SEQ ID NO: 1896 - RNA, 23 nt, synthetic construct
  source 1..23: mol_type = other RNA
gacatgagagaatttgtcttact

SEQ ID NO: 1897 - RNA, 23 nt, synthetic construct
  source 1..23: mol_type = other RNA
atgacctttgatgaaaagaagag

SEQ ID NO: 1898 - RNA, 23 nt, synthetic construct
  source 1..23: mol_type = other RNA
tgacctttgatgaaaagaagagc

SEQ ID NO: 1899 - RNA, 23 nt, synthetic construct
  source 1..23: mol_type = other RNA
gacctttgatgaaaagaagagct

SEQ ID NO: 1900 - RNA, 23 nt, synthetic construct
  source 1..23: mol_type = other RNA
acctttgatgaaaagaagagctg

SEQ ID NO: 1901 - RNA, 23 nt, synthetic construct
  source 1..23: mol_type = other RNA
cctttgatgaaaagaagagctgg

SEQ ID NO: 1902 - RNA, 23 nt, synthetic construct
  source 1..23: mol_type = other RNA
ctttgatgaaaagaagagctggt

SEQ ID NO: 1903 - RNA, 23 nt, synthetic construct
  source 1..23: mol_type = other RNA
tttgatgaaaagaagagctggta

SEQ ID NO: 1904 - RNA, 23 nt, synthetic construct
  source 1..23: mol_type = other RNA
ttgatgaaaagaagagctggtac

SEQ ID NO: 1905 - RNA, 23 nt, synthetic construct
  source 1..23: mol_type = other RNA
tgatgaaaagaagagctggtact

SEQ ID NO: 1906 - RNA, 23 nt, synthetic construct
  source 1..23: mol_type = other RNA
gatgaaaagaagagctggtacta

SEQ ID NO: 1907 - RNA, 23 nt, synthetic construct
  source 1..23: mol_type = other RNA
atgaaaagaagagctggtactat

SEQ ID NO: 1908 - RNA, 23 nt, synthetic construct
  source 1..23: mol_type = other RNA
tgaaaagaagagctggtactatg

SEQ ID NO: 1909 - RNA, 23 nt, synthetic construct
  source 1..23: mol_type = other RNA
gaaaagaagagctggtactatga

SEQ ID NO: 1910 - RNA, 23 nt, synthetic construct
  source 1..23: mol_type = other RNA
aaaagaagagctggtactatgaa

SEQ ID NO: 1911 - RNA, 23 nt, synthetic construct
  source 1..23: mol_type = other RNA
aaagaagagctggtactatgaaa

SEQ ID NO: 1912 - RNA, 23 nt, synthetic construct
  source 1..23: mol_type = other RNA
aagaagagctggtactatgaaaa

SEQ ID NO: 1913 - RNA, 23 nt, synthetic construct
  source 1..23: mol_type = other RNA
agaagagctggtactatgaaaag

SEQ ID NO: 1914 - RNA, 23 nt, synthetic construct
  source 1..23: mol_type = other RNA
gaagagctggtactatgaaaaga

SEQ ID NO: 1915 - RNA, 23 nt, synthetic construct
  source 1..23: mol_type = other RNA
aagagctggtactatgaaaagaa

SEQ ID NO: 1916 - RNA, 23 nt, synthetic construct
  source 1..23: mol_type = other RNA
agagctggtactatgaaaagaag

SEQ ID NO: 1917 - RNA, 23 nt, synthetic construct
  source 1..23: mol_type = other RNA
gagctggtactatgaaaagaagt

SEQ ID NO: 1918 - RNA, 23 nt, synthetic construct
  source 1..23: mol_type = other RNA
agctggtactatgaaaagaagtc

SEQ ID NO: 1919 - RNA, 23 nt, synthetic construct
  source 1..23: mol_type = other RNA
tcccgaagttcttggagactcac

SEQ ID NO: 1920 - RNA, 23 nt, synthetic construct
  source 1..23: mol_type = other RNA
ccgaagttcttggagactcacat

SEQ ID NO: 1921 - RNA, 23 nt, synthetic construct
  source 1..23: mol_type = other RNA
agtttcacgccattaatgggatg

SEQ ID NO: 1922 - RNA, 23 nt, synthetic construct
  source 1..23: mol_type = other RNA
ccattaatgggatgatctacagc

SEQ ID NO: 1923 - RNA, 23 nt, synthetic construct
  source 1..23: mol_type = other RNA
cggctcccaagacattcacgtgg

SEQ ID NO: 1924 - RNA, 23 nt, synthetic construct
  source 1..23: mol_type = other RNA
tcccaagacattcacgtggttca

SEQ ID NO: 1925 - RNA, 23 nt, synthetic construct
  source 1..23: mol_type = other RNA
acattcacgtggttcactttcac

SEQ ID NO: 1926 - RNA, 23 nt, synthetic construct
  source 1..23: mol_type = other RNA
ggatgcaaacgccatttcttatc

SEQ ID NO: 1927 - RNA, 23 nt, synthetic construct
  source 1..23: mol_type = other RNA
atgcaaacgccatttcttatcat

SEQ ID NO: 1928 - RNA, 23 nt, synthetic construct
  source 1..23: mol_type = other RNA
tttcttatcatggacagagactg

SEQ ID NO: 1929 - RNA, 23 nt, synthetic construct
  source 1..23: mol_type = other RNA
tcttatcatggacagagactgta

SEQ ID NO: 1930 - RNA, 23 nt, synthetic construct
  source 1..23: mol_type = other RNA
actaagcactggtatcatatctg

SEQ ID NO: 1931 - RNA, 23 nt, synthetic construct
  source 1..23: mol_type = other RNA
tatcatatctgattcacagatca

SEQ ID NO: 1932 - RNA, 23 nt, synthetic construct
  source 1..23: mol_type = other RNA
attaaacaatggtggatcttata

SEQ ID NO: 1933 - RNA, 23 nt, synthetic construct
  source 1..23: mol_type = other RNA
ttaaacaatggtggatcttataa

SEQ ID NO: 1934 - RNA, 23 nt, synthetic construct
  source 1..23: mol_type = other RNA
aacaatggtggatcttataatgc

SEQ ID NO: 1935 - RNA, 23 nt, synthetic construct
  source 1..23: mol_type = other RNA
atggtggatcttataatgcttgg

SEQ ID NO: 1936 - RNA, 23 nt, synthetic construct
  source 1..23: mol_type = other RNA
ggatcttataatgcttggagtgt

SEQ ID NO: 1937 - RNA, 23 nt, synthetic construct
  source 1..23: mol_type = other RNA
cccaaggtgccaaacactacctg

SEQ ID NO: 1938 - RNA, 23 nt, synthetic construct
  source 1..23: mol_type = other RNA
gtcctgctataccacagagttct

SEQ ID NO: 1939 - RNA, 23 nt, synthetic construct
  source 1..23: mol_type = other RNA
tcctgctataccacagagttcta

SEQ ID NO: 1940 - RNA, 23 nt, synthetic construct
  source 1..23: mol_type = other RNA
gctataccacagagttctatgta

SEQ ID NO: 1941 - RNA, 23 nt, synthetic construct
  source 1..23: mol_type = other RNA
tataccacagagttctatgtagc

SEQ ID NO: 1942 - RNA, 23 nt, synthetic construct
  source 1..23: mol_type = other RNA
taccacagagttctatgtagctt

SEQ ID NO: 1943 - RNA, 23 nt, synthetic construct
  source 1..23: mol_type = other RNA
accacagagttctatgtagctta

SEQ ID NO: 1944 - RNA, 23 nt, synthetic construct
  source 1..23: mol_type = other RNA
acagagttctatgtagcttacag

SEQ ID NO: 1945 - RNA, 23 nt, synthetic construct
  source 1..23: mol_type = other RNA
agagttctatgtagcttacagtt

SEQ ID NO: 1946 - RNA, 23 nt, synthetic construct
  source 1..23: mol_type = other RNA
gttctatgtagcttacagttcca

SEQ ID NO: 1947 - RNA, 23 nt, synthetic construct
  source 1..23: mol_type = other RNA
ggcaattcagatgcctctacaat

SEQ ID NO: 1948 - RNA, 23 nt, synthetic construct
  source 1..23: mol_type = other RNA
gcaattcagatgcctctacaata

SEQ ID NO: 1949 - RNA, 23 nt, synthetic construct
  source 1..23: mol_type = other RNA
aattcagatgcctctacaataaa

SEQ ID NO: 1950 - RNA, 23 nt, synthetic construct
  source 1..23: mol_type = other RNA
gaatcagtttgacccacctattg

SEQ ID NO: 1951 - RNA, 23 nt, synthetic construct
  source 1..23: mol_type = other RNA
aatcagtttgacccacctattgt

SEQ ID NO: 1952 - RNA, 23 nt, synthetic construct
  source 1..23: mol_type = other RNA
atcagtttgacccacctattgtg

SEQ ID NO: 1953 - RNA, 23 nt, synthetic construct
  source 1..23: mol_type = other RNA
acctattgtggctagatatatta

SEQ ID NO: 1954 - RNA, 23 nt, synthetic construct
  source 1..23: mol_type = other RNA
gtggctagatatattaggatctc

SEQ ID NO: 1955 - RNA, 23 nt, synthetic construct
  source 1..23: mol_type = other RNA
tagatatattaggatctctccaa

SEQ ID NO: 1956 - RNA, 23 nt, synthetic construct
  source 1..23: mol_type = other RNA
caagcaaatcacagcttcttcgt

SEQ ID NO: 1957 - RNA, 23 nt, synthetic construct
  source 1..23: mol_type = other RNA
gcagtggctagaaattgatctac

SEQ ID NO: 1958 - RNA, 23 nt, synthetic construct
  source 1..23: mol_type = other RNA
agaaattgatctactcaagatca

SEQ ID NO: 1959 - RNA, 23 nt, synthetic construct
  source 1..23: mol_type = other RNA
tgaaatgtatgtaaagagctata

SEQ ID NO: 1960 - RNA, 23 nt, synthetic construct
  source 1..23: mol_type = other RNA
gtatgtaaagagctataccatcc

SEQ ID NO: 1961 - RNA, 23 nt, synthetic construct
  source 1..23: mol_type = other RNA
taaagagctataccatccactac

SEQ ID NO: 1962 - RNA, 23 nt, synthetic construct
  source 1..23: mol_type = other RNA
tcctccatggtggacaagatttt

SEQ ID NO: 1963 - RNA, 23 nt, synthetic construct
  source 1..23: mol_type = other RNA
cctccatggtggacaagattttt

SEQ ID NO: 1964 - RNA, 23 nt, synthetic construct
  source 1..23: mol_type = other RNA
ctccatggtggacaagatttttg

SEQ ID NO: 1965 - RNA, 23 nt, synthetic construct
  source 1..23: mol_type = other RNA
tccatggtggacaagatttttga

SEQ ID NO: 1966 - RNA, 23 nt, synthetic construct
  source 1..23: mol_type = other RNA
ccatggtggacaagatttttgaa

SEQ ID NO: 1967 - RNA, 23 nt, synthetic construct
  source 1..23: mol_type = other RNA
catggtggacaagatttttgaag

SEQ ID NO: 1968 - RNA, 23 nt, synthetic construct
  source 1..23: mol_type = other RNA
atggtggacaagatttttgaagg

SEQ ID NO: 1969 - RNA, 23 nt, synthetic construct
  source 1..23: mol_type = other RNA
tggtggacaagatttttgaagga

SEQ ID NO: 1970 - RNA, 23 nt, synthetic construct
  source 1..23: mol_type = other RNA
ggtggacaagatttttgaaggaa

SEQ ID NO: 1971 - RNA, 23 nt, synthetic construct
  source 1..23: mol_type = other RNA
gtggacaagatttttgaaggaaa

SEQ ID NO: 1972 - RNA, 23 nt, synthetic construct
  source 1..23: mol_type = other RNA
tggacaagatttttgaaggaaat

SEQ ID NO: 1973 - RNA, 23 nt, synthetic construct
  source 1..23: mol_type = other RNA
ggacaagatttttgaaggaaata

SEQ ID NO: 1974 - RNA, 23 nt, synthetic construct
  source 1..23: mol_type = other RNA
gacaagatttttgaaggaaatac

SEQ ID NO: 1975 - RNA, 23 nt, synthetic construct
  source 1..23: mol_type = other RNA
acaagatttttgaaggaaatact

SEQ ID NO: 1976 - RNA, 23 nt, synthetic construct
  source 1..23: mol_type = other RNA
caagatttttgaaggaaatacta

SEQ ID NO: 1977 - RNA, 23 nt, synthetic construct
  source 1..23: mol_type = other RNA
aagatttttgaaggaaatactaa

SEQ ID NO: 1978 - RNA, 23 nt, synthetic construct
  source 1..23: mol_type = other RNA
agatttttgaaggaaatactaat

SEQ ID NO: 1979 - RNA, 23 nt, synthetic construct
  source 1..23: mol_type = other RNA
gatttttgaaggaaatactaata

SEQ ID NO: 1980 - RNA, 23 nt, synthetic construct
  source 1..23: mol_type = other RNA
atttttgaaggaaatactaatac

SEQ ID NO: 1981 - RNA, 23 nt, synthetic construct
  source 1..23: mol_type = other RNA
tttttgaaggaaatactaatacc

SEQ ID NO: 1982 - RNA, 23 nt, synthetic construct
  source 1..23: mol_type = other RNA
ttttgaaggaaatactaatacca

SEQ ID NO: 1983 - RNA, 23 nt, synthetic construct
  source 1..23: mol_type = other RNA
atactaataccaaaggacatgtg

SEQ ID NO: 1984 - RNA, 23 nt, synthetic construct
  source 1..23: mol_type = other RNA
tactaataccaaaggacatgtga

SEQ ID NO: 1985 - RNA, 23 nt, synthetic construct
  source 1..23: mol_type = other RNA
actaataccaaaggacatgtgaa

SEQ ID NO: 1986 - RNA, 23 nt, synthetic construct
  source 1..23: mol_type = other RNA
cccaatcatttccaggtttatcc

SEQ ID NO: 1987 - RNA, 23 nt, synthetic construct
  source 1..23: mol_type = other RNA
caatcatttccaggtttatccgt

SEQ ID NO: 1988 - RNA, 23 nt, synthetic construct
  source 1..23: mol_type = other RNA
acatggaatcaaagtattgcact

SEQ ID NO: 1989 - RNA, 23 nt, synthetic construct
  source 1..23: mol_type = other RNA
tcgcctggaactctttggctgtg

SEQ ID NO: 1990 - RNA, 21 nt, synthetic construct
  source 1..21: mol_type = other RNA
catgcctcacacacatctatt

SEQ ID NO: 1991 - RNA, 21 nt, synthetic construct
  source 1..21: mol_type = other RNA
catctattactcccatgaaat

SEQ ID NO: 1992 - RNA, 21 nt, synthetic construct
  source 1..21: mol_type = other RNA
gggacacagaagacgtttgat

SEQ ID NO: 1993 - RNA, 21 nt, synthetic construct
  source 1..21: mol_type = other RNA
ggacacagaagacgtttgact

SEQ ID NO: 1994 - RNA, 21 nt, synthetic construct
  source 1..21: mol_type = other RNA
gacacagaagacgtttgacat

SEQ ID NO: 1995 - RNA, 21 nt, synthetic construct
  source 1..21: mol_type = other RNA
acgtttgacaagcaaatcgtt

SEQ ID NO: 1996 - RNA, 21 nt, synthetic construct
  source 1..21: mol_type = other RNA
cgtttgacaagcaaatcgtgt

SEQ ID NO: 1997 - RNA, 21 nt, synthetic construct
  source 1..21: mol_type = other RNA
gtttgacaagcaaatcgtgct

SEQ ID NO: 1998 - RNA, 21 nt, synthetic construct
  source 1..21: mol_type = other RNA
tttgacaagcaaatcgtgctt

SEQ ID NO: 1999 - RNA, 21 nt, synthetic construct
  source 1..21: mol_type = other RNA
cctaatgtacacagtcaatgt

SEQ ID NO: 2000 - RNA, 21 nt, synthetic construct
  source 1..21: mol_type = other RNA
ctaatgtacacagtcaatggt

SEQ ID NO: 2001 - RNA, 21 nt, synthetic construct
  source 1..21: mol_type = other RNA
taatgtacacagtcaatggat

SEQ ID NO: 2002 - RNA, 21 nt, synthetic construct
  source 1..21: mol_type = other RNA
ggactatgcacctgtaatact

SEQ ID NO: 2003 - RNA, 21 nt, synthetic construct
  source 1..21: mol_type = other RNA
gactatgcacctgtaatacct

SEQ ID NO: 2004 - RNA, 21 nt, synthetic construct
  source 1..21: mol_type = other RNA
actatgcacctgtaataccat

SEQ ID NO: 2005 - RNA, 21 nt, synthetic construct
  source 1..21: mol_type = other RNA
ctatgcacctgtaataccagt

SEQ ID NO: 2006 - RNA, 21 nt, synthetic construct
  source 1..21: mol_type = other RNA
gcacctgtaataccagcgaat

SEQ ID NO: 2007 - RNA, 21 nt, synthetic construct
  source 1..21: mol_type = other RNA
acctgtaataccagcgaatat

SEQ ID NO: 2008 - RNA, 21 nt, synthetic construct
  source 1..21: mol_type = other RNA
cctgtaataccagcgaatatt

SEQ ID NO: 2009 - RNA, 21 nt, synthetic construct
  source 1..21: mol_type = other RNA
ctgtaataccagcgaatatgt

SEQ ID NO: 2010 - RNA, 21 nt, synthetic construct
  source 1..21: mol_type = other RNA
taataccagcgaatatggact

SEQ ID NO: 2011 - RNA, 21 nt, synthetic construct
  source 1..21: mol_type = other RNA
gagcagggatgcaaacgccat

SEQ ID NO: 2012 - RNA, 21 nt, synthetic construct
  source 1..21: mol_type = other RNA
agcagggatgcaaacgccatt

SEQ ID NO: 2013 - RNA, 21 nt, synthetic construct
  source 1..21: mol_type = other RNA
agggatgcaaacgccatttct

SEQ ID NO: 2014 - RNA, 21 nt, synthetic construct
  source 1..21: mol_type = other RNA
gggatgcaaacgccatttctt

SEQ ID NO: 2015 - RNA, 21 nt, synthetic construct
  source 1..21: mol_type = other RNA
ggatgcaaacgccatttcttt

SEQ ID NO: 2016 - RNA, 21 nt, synthetic construct
  source 1..21: mol_type = other RNA
gatgcaaacgccatttcttat

SEQ ID NO: 2017 - RNA, 21 nt, synthetic construct
  source 1..21: mol_type = other RNA
caaacgccatttcttatcatt

SEQ ID NO: 2018 - RNA, 21 nt, synthetic construct
  source 1..21: mol_type = other RNA
aaacgccatttcttatcatgt

SEQ ID NO: 2019 - RNA, 21 nt, synthetic construct
  source 1..21: mol_type = other RNA
aacgccatttcttatcatggt

SEQ ID NO: 2020 - RNA, 21 nt, synthetic construct
  source 1..21: mol_type = other RNA
acgccatttcttatcatggat

SEQ ID NO: 2021 - RNA, 21 nt, synthetic construct
  source 1..21: mol_type = other RNA
cgccatttcttatcatggact

SEQ ID NO: 2022 - RNA, 21 nt, synthetic construct
  source 1..21: mol_type = other RNA
atgggactaagcactggtatt

SEQ ID NO: 2023 - RNA, 21 nt, synthetic construct
  source 1..21: mol_type = other RNA
tgggactaagcactggtatct

SEQ ID NO: 2024 - RNA, 21 nt, synthetic construct
  source 1..21: mol_type = other RNA
gggactaagcactggtatcat

SEQ ID NO: 2025 - RNA, 21 nt, synthetic construct
  source 1..21: mol_type = other RNA
ggactaagcactggtatcatt

SEQ ID NO: 2026 - RNA, 21 nt, synthetic construct
  source 1..21: mol_type = other RNA
ctaagcactggtatcatatct

SEQ ID NO: 2027 - RNA, 21 nt, synthetic construct
  source 1..21: mol_type = other RNA
aagcactggtatcatatctgt

SEQ ID NO: 2028 - RNA, 21 nt, synthetic construct
  source 1..21: mol_type = other RNA
agcactggtatcatatctgat

SEQ ID NO: 2029 - RNA, 21 nt, synthetic construct
  source 1..21: mol_type = other RNA
gcactggtatcatatctgatt

SEQ ID NO: 2030 - RNA, 21 nt, synthetic construct
  source 1..21: mol_type = other RNA
cactggtatcatatctgattt

SEQ ID NO: 2031 - RNA, 21 nt, synthetic construct
  source 1..21: mol_type = other RNA
tggtatcatatctgattcact

SEQ ID NO: 2032 - RNA, 21 nt, synthetic construct
  source 1..21: mol_type = other RNA
ctgaagtcctgctataccact

SEQ ID NO: 2033 - RNA, 21 nt, synthetic construct
  source 1..21: mol_type = other RNA
tgctataccacagagttctat

SEQ ID NO: 2034 - RNA, 21 nt, synthetic construct
  source 1..21: mol_type = other RNA
gctataccacagagttctatt

SEQ ID NO: 2035 - RNA, 21 nt, synthetic construct
  source 1..21: mol_type = other RNA
ctataccacagagttctatgt

SEQ ID NO: 2036 - RNA, 21 nt, synthetic construct
  source 1..21: mol_type = other RNA
ataccacagagttctatgtat

SEQ ID NO: 2037 - RNA, 21 nt, synthetic construct
  source 1..21: mol_type = other RNA
accacagagttctatgtagct

SEQ ID NO: 2038 - RNA, 21 nt, synthetic construct
  source 1..21: mol_type = other RNA
gagttctatgtagcttacagt

SEQ ID NO: 2039 - RNA, 21 nt, synthetic construct
  source 1..21: mol_type = other RNA
ctatgtagcttacagttccat

SEQ ID NO: 2040 - RNA, 21 nt, synthetic construct
  source 1..21: mol_type = other RNA
tatgtagcttacagttccaat

SEQ ID NO: 2041 - RNA, 21 nt, synthetic construct
  source 1..21: mol_type = other RNA
tagcttacagttccaaccagt

SEQ ID NO: 2042 - RNA, 21 nt, synthetic construct
  source 1..21: mol_type = other RNA
acctattgtggctagatatat

SEQ ID NO: 2043 - RNA, 21 nt, synthetic construct
  source 1..21: mol_type = other RNA
cctattgtggctagatatatt

SEQ ID NO: 2044 - RNA, 21 nt, synthetic construct
  source 1..21: mol_type = other RNA
tattgtggctagatatattat

SEQ ID NO: 2045 - RNA, 21 nt, synthetic construct
  source 1..21: mol_type = other RNA
attgtggctagatatattagt

SEQ ID NO: 2046 - RNA, 21 nt, synthetic construct
  source 1..21: mol_type = other RNA
ttgtggctagatatattaggt

SEQ ID NO: 2047 - RNA, 21 nt, synthetic construct
  source 1..21: mol_type = other RNA
tgtggctagatatattaggat

SEQ ID NO: 2048 - RNA, 21 nt, synthetic construct
  source 1..21: mol_type = other RNA
gtggctagatatattaggatt

SEQ ID NO: 2049 - RNA, 21 nt, synthetic construct
  source 1..21: mol_type = other RNA
gctagatatattaggatctct

SEQ ID NO: 2050 - RNA, 23 nt, synthetic construct
  source 1..23: mol_type = other RNA
aatagatgtgtgtgaggcatgga

SEQ ID NO: 2051 - RNA, 23 nt, synthetic construct
  source 1..23: mol_type = other RNA
aaatagatgtgtgtgaggcatgg

SEQ ID NO: 2052 - RNA, 23 nt, synthetic construct
  source 1..23: mol_type = other RNA
ataatagatgtgtgtgaggcatg

SEQ ID NO: 2053 - RNA, 23 nt, synthetic construct
  source 1..23: mol_type = other RNA
agtaatagatgtgtgtgaggcat

SEQ ID NO: 2054 - RNA, 23 nt, synthetic construct
  source 1..23: mol_type = other RNA
aagtaatagatgtgtgtgaggca

SEQ ID NO: 2055 - RNA, 23 nt, synthetic construct
  source 1..23: mol_type = other RNA
agagtaatagatgtgtgtgaggc

SEQ ID NO: 2056 - RNA, 23 nt, synthetic construct
  source 1..23: mol_type = other RNA
atttcatgggagtaatagatgtg

SEQ ID NO: 2057 - RNA, 23 nt, synthetic construct
  source 1..23: mol_type = other RNA
atcaaacgtcttctgtgtcccac

SEQ ID NO: 2058 - RNA, 23 nt, synthetic construct
  source 1..23: mol_type = other RNA
agtcaaacgtcttctgtgtccca

SEQ ID NO: 2059 - RNA, 23 nt, synthetic construct
  source 1..23: mol_type = other RNA
atgtcaaacgtcttctgtgtccc

SEQ ID NO: 2060 - RNA, 23 nt, synthetic construct
  source 1..23: mol_type = other RNA
atttgcttgtcaaacgtcttctg

SEQ ID NO: 2061 - RNA, 23 nt, synthetic construct
  source 1..23: mol_type = other RNA
acgatttgcttgtcaaacgtctt

SEQ ID NO: 2062 - RNA, 23 nt, synthetic construct
  source 1..23: mol_type = other RNA
aacgatttgcttgtcaaacgtct

SEQ ID NO: 2063 - RNA, 23 nt, synthetic construct
  source 1..23: mol_type = other RNA
acacgatttgcttgtcaaacgtc

SEQ ID NO: 2064 - RNA, 23 nt, synthetic construct
  source 1..23: mol_type = other RNA
agcacgatttgcttgtcaaacgt

SEQ ID NO: 2065 - RNA, 23 nt, synthetic construct
  source 1..23: mol_type = other RNA
aagcacgatttgcttgtcaaacg

SEQ ID NO: 2066 - RNA, 23 nt, synthetic construct
  source 1..23: mol_type = other RNA
acattgactgtgtacattaggga

SEQ ID NO: 2067 - RNA, 23 nt, synthetic construct
  source 1..23: mol_type = other RNA
accattgactgtgtacattaggg

SEQ ID NO: 2068 - RNA, 23 nt, synthetic construct
  source 1..23: mol_type = other RNA
atccattgactgtgtacattagg

SEQ ID NO: 2069 - RNA, 23 nt, synthetic construct
  source 1..23: mol_type = other RNA
aatccattgactgtgtacattag

SEQ ID NO: 2070 - RNA, 23 nt, synthetic construct
  source 1..23: mol_type = other RNA
agtattacaggtgcatagtccca

SEQ ID NO: 2071 - RNA, 23 nt, synthetic construct
  source 1..23: mol_type = other RNA
aggtattacaggtgcatagtccc

SEQ ID NO: 2072 - RNA, 23 nt, synthetic construct
  source 1..23: mol_type = other RNA
atggtattacaggtgcatagtcc

SEQ ID NO: 2073 - RNA, 23 nt, synthetic construct
  source 1..23: mol_type = other RNA
actggtattacaggtgcatagtc

SEQ ID NO: 2074 - RNA, 23 nt, synthetic construct
  source 1..23: mol_type = other RNA
attcgctggtattacaggtgcat

SEQ ID NO: 2075 - RNA, 23 nt, synthetic construct
  source 1..23: mol_type = other RNA
atattcgctggtattacaggtgc

SEQ ID NO: 2076 - RNA, 23 nt, synthetic construct
  source 1..23: mol_type = other RNA
aatattcgctggtattacaggtg

SEQ ID NO: 2077 - RNA, 23 nt, synthetic construct
  source 1..23: mol_type = other RNA
acatattcgctggtattacaggt

SEQ ID NO: 2078 - RNA, 23 nt, synthetic construct
  source 1..23: mol_type = other RNA
accatattcgctggtattacagg

SEQ ID NO: 2079 - RNA, 23 nt, synthetic construct
  source 1..23: mol_type = other RNA
atccatattcgctggtattacag

SEQ ID NO: 2080 - RNA, 23 nt, synthetic construct
  source 1..23: mol_type = other RNA
agtccatattcgctggtattaca

SEQ ID NO: 2081 - RNA, 23 nt, synthetic construct
  source 1..23: mol_type = other RNA
atggcgtttgcatccctgctctc

SEQ ID NO: 2082 - RNA, 23 nt, synthetic construct
  source 1..23: mol_type = other RNA
aatggcgtttgcatccctgctct

SEQ ID NO: 2083 - RNA, 23 nt, synthetic construct
  source 1..23: mol_type = other RNA
agaaatggcgtttgcatccctgc

SEQ ID NO: 2084 - RNA, 23 nt, synthetic construct
  source 1..23: mol_type = other RNA
aagaaatggcgtttgcatccctg

SEQ ID NO: 2085 - RNA, 23 nt, synthetic construct
  source 1..23: mol_type = other RNA
aaagaaatggcgtttgcatccct

SEQ ID NO: 2086 - RNA, 23 nt, synthetic construct
  source 1..23: mol_type = other RNA
ataagaaatggcgtttgcatccc

SEQ ID NO: 2087 - RNA, 23 nt, synthetic construct
  source 1..23: mol_type = other RNA
atgataagaaatggcgtttgcat

SEQ ID NO: 2088 - RNA, 23 nt, synthetic construct
  source 1..23: mol_type = other RNA
aatgataagaaatggcgtttgca

SEQ ID NO: 2089 - RNA, 23 nt, synthetic construct
  source 1..23: mol_type = other RNA
acatgataagaaatggcgtttgc

SEQ ID NO: 2090 - RNA, 23 nt, synthetic construct
  source 1..23: mol_type = other RNA
accatgataagaaatggcgtttg

SEQ ID NO: 2091 - RNA, 23 nt, synthetic construct
  source 1..23: mol_type = other RNA
atccatgataagaaatggcgttt

SEQ ID NO: 2092 - RNA, 23 nt, synthetic construct
  source 1..23: mol_type = other RNA
agtccatgataagaaatggcgtt

SEQ ID NO: 2093 - RNA, 23 nt, synthetic construct
  source 1..23: mol_type = other RNA
aataccagtgcttagtcccattg

SEQ ID NO: 2094 - RNA, 23 nt, synthetic construct
  source 1..23: mol_type = other RNA
agataccagtgcttagtcccatt

SEQ ID NO: 2095 - RNA, 23 nt, synthetic construct
  source 1..23: mol_type = other RNA
atgataccagtgcttagtcccat

SEQ ID NO: 2096 - RNA, 23 nt, synthetic construct
  source 1..23: mol_type = other RNA
aatgataccagtgcttagtccca

SEQ ID NO: 2097 - RNA, 23 nt, synthetic construct
  source 1..23: mol_type = other RNA
agatatgataccagtgcttagtc

SEQ ID NO: 2098 - RNA, 23 nt, synthetic construct
  source 1..23: mol_type = other RNA
aagatatgataccagtgcttagt

SEQ ID NO: 2099 - RNA, 23 nt, synthetic construct
  source 1..23: mol_type = other RNA
acagatatgataccagtgcttag

SEQ ID NO: 2100 - RNA, 23 nt, synthetic construct
  source 1..23: mol_type = other RNA
atcagatatgataccagtgctta

SEQ ID NO: 2101 - RNA, 23 nt, synthetic construct
  source 1..23: mol_type = other RNA
aatcagatatgataccagtgctt

SEQ ID NO: 2102 - RNA, 23 nt, synthetic construct
  source 1..23: mol_type = other RNA
aaatcagatatgataccagtgct

SEQ ID NO: 2103 - RNA, 23 nt, synthetic construct
  source 1..23: mol_type = other RNA
agtgaatcagatatgataccagt

SEQ ID NO: 2104 - RNA, 23 nt, synthetic construct
  source 1..23: mol_type = other RNA
agtggtatagcaggacttcaggt

SEQ ID NO: 2105 - RNA, 23 nt, synthetic construct
  source 1..23: mol_type = other RNA
aagaactctgtggtatagcagga

SEQ ID NO: 2106 - RNA, 23 nt, synthetic construct
  source 1..23: mol_type = other RNA
atagaactctgtggtatagcagg

SEQ ID NO: 2107 - RNA, 23 nt, synthetic construct
  source 1..23: mol_type = other RNA
aatagaactctgtggtatagcag

SEQ ID NO: 2108 - RNA, 23 nt, synthetic construct
  source 1..23: mol_type = other RNA
acatagaactctgtggtatagca

SEQ ID NO: 2109 - RNA, 23 nt, synthetic construct
  source 1..23: mol_type = other RNA
aacatagaactctgtggtatagc

SEQ ID NO: 2110 - RNA, 23 nt, synthetic construct
  source 1..23: mol_type = other RNA
atacatagaactctgtggtatag

SEQ ID NO: 2111 - RNA, 23 nt, synthetic construct
  source 1..23: mol_type = other RNA
actacatagaactctgtggtata

SEQ ID NO: 2112 - RNA, 23 nt, synthetic construct
  source 1..23: mol_type = other RNA
agctacatagaactctgtggtat

SEQ ID NO: 2113 - RNA, 23 nt, synthetic construct
  source 1..23: mol_type = other RNA
aagctacatagaactctgtggta

SEQ ID NO: 2114 - RNA, 23 nt, synthetic construct
  source 1..23: mol_type = other RNA
actgtaagctacatagaactctg

SEQ ID NO: 2115 - RNA, 23 nt, synthetic construct
  source 1..23: mol_type = other RNA
aggaactgtaagctacatagaac

SEQ ID NO: 2116 - RNA, 23 nt, synthetic construct
  source 1..23: mol_type = other RNA
atggaactgtaagctacatagaa

SEQ ID NO: 2117 - RNA, 23 nt, synthetic construct
  source 1..23: mol_type = other RNA
attggaactgtaagctacataga

SEQ ID NO: 2118 - RNA, 23 nt, synthetic construct
  source 1..23: mol_type = other RNA
actggttggaactgtaagctaca

SEQ ID NO: 2119 - RNA, 23 nt, synthetic construct
  source 1..23: mol_type = other RNA
atatatctagccacaataggtgg

SEQ ID NO: 2120 - RNA, 23 nt, synthetic construct
  source 1..23: mol_type = other RNA
aatatatctagccacaataggtg

SEQ ID NO: 2121 - RNA, 23 nt, synthetic construct
  source 1..23: mol_type = other RNA
ataatatatctagccacaatagg

SEQ ID NO: 2122 - RNA, 23 nt, synthetic construct
  source 1..23: mol_type = other RNA
actaatatatctagccacaatag

SEQ ID NO: 2123 - RNA, 23 nt, synthetic construct
  source 1..23: mol_type = other RNA
acctaatatatctagccacaata

SEQ ID NO: 2124 - RNA, 23 nt, synthetic construct
  source 1..23: mol_type = other RNA
atcctaatatatctagccacaat

SEQ ID NO: 2125 - RNA, 23 nt, synthetic construct
  source 1..23: mol_type = other RNA
aatcctaatatatctagccacaa

SEQ ID NO: 2126 - RNA, 23 nt, synthetic construct
  source 1..23: mol_type = other RNA
aagatcctaatatatctagccac

SEQ ID NO: 2127 - RNA, 23 nt, synthetic construct
  source 1..23: mol_type = other RNA
agagatcctaatatatctagcca

SEQ ID NO: 2128 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catgcctcacacacatctatt

SEQ ID NO: 2129 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcctcacacacatctattt

SEQ ID NO: 2130 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcctcacacacatctattat

SEQ ID NO: 2131 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcctcacacacatctattact

SEQ ID NO: 2132 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctcacacacatctattactt

SEQ ID NO: 2133 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctcacacacatctattactct

SEQ ID NO: 2134 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catctattactcccatgaaat

SEQ ID NO: 2135 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggacacagaagacgtttgat

SEQ ID NO: 2136 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggacacagaagacgtttgact

SEQ ID NO: 2137 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacacagaagacgtttgacat

SEQ ID NO: 2138 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacgtttgacaagcaaatcgt

SEQ ID NO: 2139 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acgtttgacaagcaaatcgtt

SEQ ID NO: 2140 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgtttgacaagcaaatcgtgt

SEQ ID NO: 2141 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtttgacaagcaaatcgtgct

SEQ ID NO: 2142 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttgacaagcaaatcgtgctt

SEQ ID NO: 2143 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctaatgtacacagtcaatgt

SEQ ID NO: 2144 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctaatgtacacagtcaatggt

SEQ ID NO: 2145 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taatgtacacagtcaatggat

SEQ ID NO: 2146 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgtacacagtcaatggatt

SEQ ID NO: 2147 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggactatgcacctgtaatact

SEQ ID NO: 2148 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactatgcacctgtaatacct

SEQ ID NO: 2149 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actatgcacctgtaataccat

SEQ ID NO: 2150 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctatgcacctgtaataccagt

SEQ ID NO: 2151 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcacctgtaataccagcgaat

SEQ ID NO: 2152 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacctgtaataccagcgaatt

SEQ ID NO: 2153 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acctgtaataccagcgaatat

SEQ ID NO: 2154 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctgtaataccagcgaatatt

SEQ ID NO: 2155 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtaataccagcgaatatgt

SEQ ID NO: 2156 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtaataccagcgaatatggt

SEQ ID NO: 2157 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtaataccagcgaatatggat

SEQ ID NO: 2158 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taataccagcgaatatggact

SEQ ID NO: 2159 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcagggatgcaaacgccat

SEQ ID NO: 2160 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcagggatgcaaacgccatt

SEQ ID NO: 2161 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agggatgcaaacgccatttct

SEQ ID NO: 2162 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggatgcaaacgccatttctt

SEQ ID NO: 2163 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggatgcaaacgccatttcttt

SEQ ID NO: 2164 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatgcaaacgccatttcttat

SEQ ID NO: 2165 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcaaacgccatttcttatt

SEQ ID NO: 2166 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaacgccatttcttatcat

SEQ ID NO: 2167 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaacgccatttcttatcatt

SEQ ID NO: 2168 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaacgccatttcttatcatgt

SEQ ID NO: 2169 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacgccatttcttatcatggt

SEQ ID NO: 2170 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acgccatttcttatcatggat

SEQ ID NO: 2171 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgccatttcttatcatggact

SEQ ID NO: 2172 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgggactaagcactggtatt

SEQ ID NO: 2173 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggactaagcactggtatct

SEQ ID NO: 2174 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggactaagcactggtatcat

SEQ ID NO: 2175 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggactaagcactggtatcatt

SEQ ID NO: 2176 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctaagcactggtatcatatct

SEQ ID NO: 2177 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taagcactggtatcatatctt

SEQ ID NO: 2178 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagcactggtatcatatctgt

SEQ ID NO: 2179 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcactggtatcatatctgat

SEQ ID NO: 2180 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcactggtatcatatctgatt

SEQ ID NO: 2181 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cactggtatcatatctgattt

SEQ ID NO: 2182 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtatcatatctgattcact

SEQ ID NO: 2183 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgaagtcctgctataccact

SEQ ID NO: 2184 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgctataccacagagttctat

SEQ ID NO: 2185 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctataccacagagttctatt

SEQ ID NO: 2186 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctataccacagagttctatgt

SEQ ID NO: 2187 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tataccacagagttctatgtt

SEQ ID NO: 2188 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ataccacagagttctatgtat

SEQ ID NO: 2189 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taccacagagttctatgtagt

SEQ ID NO: 2190 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accacagagttctatgtagct

SEQ ID NO: 2191 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacagagttctatgtagcttt

SEQ ID NO: 2192 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagttctatgtagcttacagt

SEQ ID NO: 2193 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agttctatgtagcttacagtt

SEQ ID NO: 2194 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctatgtagcttacagttccat

SEQ ID NO: 2195 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgtagcttacagttccaat

SEQ ID NO: 2196 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagcttacagttccaaccagt

SEQ ID NO: 2197 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acctattgtggctagatatat

SEQ ID NO: 2198 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctattgtggctagatatatt

SEQ ID NO: 2199 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctattgtggctagatatattt

SEQ ID NO: 2200 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tattgtggctagatatattat

SEQ ID NO: 2201 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgtggctagatatattagt

SEQ ID NO: 2202 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgtggctagatatattaggt

SEQ ID NO: 2203 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtggctagatatattaggat

SEQ ID NO: 2204 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggctagatatattaggatt

SEQ ID NO: 2205 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctagatatattaggatctct

SEQ ID NO: 2206 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aatagatgtgtgtgaggcatgga

SEQ ID NO: 2207 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
aaatagatgtgtgtgaggcatgg

SEQ ID NO: 2208 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
ataatagatgtgtgtgaggcatg

SEQ ID NO: 2209 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
agtaatagatgtgtgtgaggcat

SEQ ID NO: 2210 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aagtaatagatgtgtgtgaggca

SEQ ID NO: 2211 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
agagtaatagatgtgtgtgaggc

SEQ ID NO: 2212 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
atttcatgggagtaatagatgtg

SEQ ID NO: 2213 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
atcaaacgtcttctgtgtcccac

SEQ ID NO: 2214 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
agtcaaacgtcttctgtgtccca

SEQ ID NO: 2215 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
atgtcaaacgtcttctgtgtccc

SEQ ID NO: 2216 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
atttgcttgtcaaacgtcttctg

SEQ ID NO: 2217 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
acgatttgcttgtcaaacgtctt

SEQ ID NO: 2218 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aacgatttgcttgtcaaacgtct

SEQ ID NO: 2219 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
acacgatttgcttgtcaaacgtc

SEQ ID NO: 2220 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agcacgatttgcttgtcaaacgt

SEQ ID NO: 2221 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
aagcacgatttgcttgtcaaacg

SEQ ID NO: 2222 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acattgactgtgtacattaggga

SEQ ID NO: 2223 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
accattgactgtgtacattaggg

SEQ ID NO: 2224 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atccattgactgtgtacattagg

SEQ ID NO: 2225 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aatccattgactgtgtacattag

SEQ ID NO: 2226 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
agtattacaggtgcatagtccca

SEQ ID NO: 2227 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
aggtattacaggtgcatagtccc

SEQ ID NO: 2228 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
atggtattacaggtgcatagtcc

SEQ ID NO: 2229 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
actggtattacaggtgcatagtc

SEQ ID NO: 2230 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
attcgctggtattacaggtgcat

SEQ ID NO: 2231 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aattcgctggtattacaggtgca

SEQ ID NO: 2232 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
atattcgctggtattacaggtgc

SEQ ID NO: 2233 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aatattcgctggtattacaggtg

SEQ ID NO: 2234 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
acatattcgctggtattacaggt

SEQ ID NO: 2235 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
accatattcgctggtattacagg

SEQ ID NO: 2236 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
atccatattcgctggtattacag

SEQ ID NO: 2237 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
agtccatattcgctggtattaca

SEQ ID NO: 2238 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
atggcgtttgcatccctgctctc

SEQ ID NO: 2239 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aatggcgtttgcatccctgctct

SEQ ID NO: 2240 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
agaaatggcgtttgcatccctgc

SEQ ID NO: 2241 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aagaaatggcgtttgcatccctg

SEQ ID NO: 2242 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aaagaaatggcgtttgcatccct

SEQ ID NO: 2243 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ataagaaatggcgtttgcatccc

SEQ ID NO: 2244 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
aataagaaatggcgtttgcatcc

SEQ ID NO: 2245 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
atgataagaaatggcgtttgcat

SEQ ID NO: 2246 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aatgataagaaatggcgtttgca

SEQ ID NO: 2247 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
acatgataagaaatggcgtttgc

SEQ ID NO: 2248 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
accatgataagaaatggcgtttg

SEQ ID NO: 2249 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
atccatgataagaaatggcgttt

SEQ ID NO: 2250 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
agtccatgataagaaatggcgtt

SEQ ID NO: 2251 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aataccagtgcttagtcccattg

SEQ ID NO: 2252 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
agataccagtgcttagtcccatt

SEQ ID NO: 2253 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
atgataccagtgcttagtcccat

SEQ ID NO: 2254 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aatgataccagtgcttagtccca

SEQ ID NO: 2255 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agatatgataccagtgcttagtc

SEQ ID NO: 2256 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aagatatgataccagtgcttagt

SEQ ID NO: 2257 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
acagatatgataccagtgcttag

SEQ ID NO: 2258 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
atcagatatgataccagtgctta

SEQ ID NO: 2259 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
aatcagatatgataccagtgctt

SEQ ID NO: 2260 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aaatcagatatgataccagtgct

SEQ ID NO: 2261 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agtgaatcagatatgataccagt

SEQ ID NO: 2262 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agtggtatagcaggacttcaggt

SEQ ID NO: 2263 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aagaactctgtggtatagcagga

SEQ ID NO: 2264 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atagaactctgtggtatagcagg

SEQ ID NO: 2265 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aatagaactctgtggtatagcag

SEQ ID NO: 2266 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
acatagaactctgtggtatagca

SEQ ID NO: 2267 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aacatagaactctgtggtatagc

SEQ ID NO: 2268 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
atacatagaactctgtggtatag

SEQ ID NO: 2269 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
actacatagaactctgtggtata

SEQ ID NO: 2270 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
agctacatagaactctgtggtat

SEQ ID NO: 2271 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aagctacatagaactctgtggta

SEQ ID NO: 2272 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aaagctacatagaactctgtggt

SEQ ID NO: 2273 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
atgtaagctacatagaactctgt

SEQ ID NO: 2274 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
actgtaagctacatagaactctg

SEQ ID NO: 2275 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aactgtaagctacatagaactct

SEQ ID NO: 2276 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
aggaactgtaagctacatagaac

SEQ ID NO: 2277 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
atggaactgtaagctacatagaa

SEQ ID NO: 2278 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
attggaactgtaagctacataga

SEQ ID NO: 2279 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
actggttggaactgtaagctaca

SEQ ID NO: 2280 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atatatctagccacaataggtgg

SEQ ID NO: 2281 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aatatatctagccacaataggtg

SEQ ID NO: 2282 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aaatatatctagccacaataggt

SEQ ID NO: 2283 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ataatatatctagccacaatagg

SEQ ID NO: 2284 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
actaatatatctagccacaatag

SEQ ID NO: 2285 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
acctaatatatctagccacaata

SEQ ID NO: 2286 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
atcctaatatatctagccacaat

SEQ ID NO: 2287 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
aatcctaatatatctagccacaa

SEQ ID NO: 2288 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
aagatcctaatatatctagccac

SEQ ID NO: 2289 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
agagatcctaatatatctagcca

SEQ ID NO: 2290 - RNA, 23 nt, synthetic construct
  source 1..23: mol_type = other RNA
tccatgcctcacacacatctatt

SEQ ID NO: 2291 - RNA, 23 nt, synthetic construct
  source 1..23: mol_type = other RNA
cacatctattactcccatgaaaa

SEQ ID NO: 2292 - RNA, 23 nt, synthetic construct
  source 1..23: mol_type = other RNA
gtgggacacagaagacgtttgac

SEQ ID NO: 2293 - RNA, 23 nt, synthetic construct
  source 1..23: mol_type = other RNA
tgggacacagaagacgtttgaca

SEQ ID NO: 2294 - RNA, 23 nt, synthetic construct
  source 1..23: mol_type = other RNA
gggacacagaagacgtttgacaa

SEQ ID NO: 2295 - RNA, 23 nt, synthetic construct
  source 1..23: mol_type = other RNA
agacgtttgacaagcaaatcgtg

SEQ ID NO: 2296 - RNA, 23 nt, synthetic construct
  source 1..23: mol_type = other RNA
gacgtttgacaagcaaatcgtgc

SEQ ID NO: 2297 - RNA, 23 nt, synthetic construct
  source 1..23: mol_type = other RNA
acgtttgacaagcaaatcgtgct

SEQ ID NO: 2298 - RNA, 23 nt, synthetic construct
  source 1..23: mol_type = other RNA
cgtttgacaagcaaatcgtgcta

SEQ ID NO: 2299 - RNA, 23 nt, synthetic construct
  source 1..23: mol_type = other RNA
tccctaatgtacacagtcaatgg

SEQ ID NO: 2300 - RNA, 23 nt, synthetic construct
  source 1..23: mol_type = other RNA
ccctaatgtacacagtcaatgga

SEQ ID NO: 2301 - RNA, 23 nt, synthetic construct
  source 1..23: mol_type = other RNA
cctaatgtacacagtcaatggat

SEQ ID NO: 2302 - RNA, 23 nt, synthetic construct
  source 1..23: mol_type = other RNA
tgggactatgcacctgtaatacc

SEQ ID NO: 2303 - RNA, 23 nt, synthetic construct
  source 1..23: mol_type = other RNA
gggactatgcacctgtaatacca

SEQ ID NO: 2304 - RNA, 23 nt, synthetic construct
  source 1..23: mol_type = other RNA
ggactatgcacctgtaataccag

SEQ ID NO: 2305 - RNA, 23 nt, synthetic construct
  source 1..23: mol_type = other RNA
gactatgcacctgtaataccagc

SEQ ID NO: 2306 - RNA, 23 nt, synthetic construct
  source 1..23: mol_type = other RNA
atgcacctgtaataccagcgaat

SEQ ID NO: 2307 - RNA, 23 nt, synthetic construct
  source 1..23: mol_type = other RNA
gcacctgtaataccagcgaatat

SEQ ID NO: 2308 - RNA, 23 nt, synthetic construct
  source 1..23: mol_type = other RNA
cacctgtaataccagcgaatatg

SEQ ID NO: 2309 - RNA, 23 nt, synthetic construct
  source 1..23: mol_type = other RNA
acctgtaataccagcgaatatgg

SEQ ID NO: 2310 - RNA, 23 nt, synthetic construct
  source 1..23: mol_type = other RNA
tgtaataccagcgaatatggaca

SEQ ID NO: 2311 - RNA, 23 nt, synthetic construct
  source 1..23: mol_type = other RNA
gagagcagggatgcaaacgccat

SEQ ID NO: 2312 - RNA, 23 nt, synthetic construct
  source 1..23: mol_type = other RNA
agagcagggatgcaaacgccatt

SEQ ID NO: 2313 - RNA, 23 nt, synthetic construct
  source 1..23: mol_type = other RNA
gcagggatgcaaacgccatttct

SEQ ID NO: 2314 - RNA, 23 nt, synthetic construct
  source 1..23: mol_type = other RNA
cagggatgcaaacgccatttctt

SEQ ID NO: 2315 - RNA, 23 nt, synthetic construct
  source 1..23: mol_type = other RNA
agggatgcaaacgccatttctta

SEQ ID NO: 2316 - RNA, 23 nt, synthetic construct
  source 1..23: mol_type = other RNA
gggatgcaaacgccatttcttat

SEQ ID NO: 2317 - RNA, 23 nt, synthetic construct
  source 1..23: mol_type = other RNA
tgcaaacgccatttcttatcatg

SEQ ID NO: 2318 - RNA, 23 nt, synthetic construct
  source 1..23: mol_type = other RNA
gcaaacgccatttcttatcatgg

SEQ ID NO: 2319 - RNA, 23 nt, synthetic construct
  source 1..23: mol_type = other RNA
caaacgccatttcttatcatgga

SEQ ID NO: 2320 - RNA, 23 nt, synthetic construct
  source 1..23: mol_type = other RNA
aaacgccatttcttatcatggac

SEQ ID NO: 2321 - RNA, 23 nt, synthetic construct
  source 1..23: mol_type = other RNA
aacgccatttcttatcatggaca

SEQ ID NO: 2322 - RNA, 23 nt, synthetic construct
  source 1..23: mol_type = other RNA
caatgggactaagcactggtatc

SEQ ID NO: 2323 - RNA, 23 nt, synthetic construct
  source 1..23: mol_type = other RNA
aatgggactaagcactggtatca

SEQ ID NO: 2324 - RNA, 23 nt, synthetic construct
  source 1..23: mol_type = other RNA
atgggactaagcactggtatcat

SEQ ID NO: 2325 - RNA, 23 nt, synthetic construct
  source 1..23: mol_type = other RNA
tgggactaagcactggtatcata

SEQ ID NO: 2326 - RNA, 23 nt, synthetic construct
  source 1..23: mol_type = other RNA
gactaagcactggtatcatatct

SEQ ID NO: 2327 - RNA, 23 nt, synthetic construct
  source 1..23: mol_type = other RNA
ctaagcactggtatcatatctga

SEQ ID NO: 2328 - RNA, 23 nt, synthetic construct
  source 1..23: mol_type = other RNA
taagcactggtatcatatctgat

SEQ ID NO: 2329 - RNA, 23 nt, synthetic construct
  source 1..23: mol_type = other RNA
aagcactggtatcatatctgatt

SEQ ID NO: 2330 - RNA, 23 nt, synthetic construct
  source 1..23: mol_type = other RNA
agcactggtatcatatctgattc

SEQ ID NO: 2331 - RNA, 23 nt, synthetic construct
  source 1..23: mol_type = other RNA
actggtatcatatctgattcaca

SEQ ID NO: 2332 - RNA, 23 nt, synthetic construct
  source 1..23: mol_type = other RNA
acctgaagtcctgctataccaca

SEQ ID NO: 2333 - RNA, 23 nt, synthetic construct
  source 1..23: mol_type = other RNA
cctgctataccacagagttctat

SEQ ID NO: 2334 - RNA, 23 nt, synthetic construct
  source 1..23: mol_type = other RNA
ctgctataccacagagttctatg

SEQ ID NO: 2335 - RNA, 23 nt, synthetic construct
  source 1..23: mol_type = other RNA
tgctataccacagagttctatgt

SEQ ID NO: 2336 - RNA, 23 nt, synthetic construct
  source 1..23: mol_type = other RNA
ctataccacagagttctatgtag

SEQ ID NO: 2337 - RNA, 23 nt, synthetic construct
  source 1..23: mol_type = other RNA
ataccacagagttctatgtagct

SEQ ID NO: 2338 - RNA, 23 nt, synthetic construct
  source 1..23: mol_type = other RNA
cagagttctatgtagcttacagt

SEQ ID NO: 2339 - RNA, 23 nt, synthetic construct
  source 1..23: mol_type = other RNA
ttctatgtagcttacagttccaa

SEQ ID NO: 2340 - RNA, 23 nt, synthetic construct
  source 1..23: mol_type = other RNA
tctatgtagcttacagttccaac

SEQ ID NO: 2341 - RNA, 23 nt, synthetic construct
  source 1..23: mol_type = other RNA
tgtagcttacagttccaaccaga

SEQ ID NO: 2342 - RNA, 23 nt, synthetic construct
  source 1..23: mol_type = other RNA
ccacctattgtggctagatatat

SEQ ID NO: 2343 - RNA, 23 nt, synthetic construct
  source 1..23: mol_type = other RNA
cacctattgtggctagatatatt

SEQ ID NO: 2344 - RNA, 23 nt, synthetic construct
  source 1..23: mol_type = other RNA
cctattgtggctagatatattag

SEQ ID NO: 2345 - RNA, 23 nt, synthetic construct
  source 1..23: mol_type = other RNA
ctattgtggctagatatattagg

SEQ ID NO: 2346 - RNA, 23 nt, synthetic construct
  source 1..23: mol_type = other RNA
tattgtggctagatatattagga

SEQ ID NO: 2347 - RNA, 23 nt, synthetic construct
  source 1..23: mol_type = other RNA
attgtggctagatatattaggat

SEQ ID NO: 2348 - RNA, 23 nt, synthetic construct
  source 1..23: mol_type = other RNA
ttgtggctagatatattaggatc

SEQ ID NO: 2349 - RNA, 23 nt, synthetic construct
  source 1..23: mol_type = other RNA
tggctagatatattaggatctct

SEQ ID NO: 2350 - RNA, 21 nt, synthetic construct
  source 1..21: mol_type = other RNA
agaactcagttctcaattctt

SEQ ID NO: 2351 - RNA, 21 nt, synthetic construct
  source 1..21: mol_type = other RNA
tcctactctcaatgatacttt

SEQ ID NO: 2352 - RNA, 21 nt, synthetic construct
  source 1..21: mol_type = other RNA
acacactcaaaatcgtgttct

SEQ ID NO: 2353 - RNA, 21 nt, synthetic construct
  source 1..21: mol_type = other RNA
gttaacttccatgaattctat

SEQ ID NO: 2354 - RNA, 21 nt, synthetic construct
  source 1..21: mol_type = other RNA
ctactctcaatgatacttttt

SEQ ID NO: 2355 - RNA, 21 nt, synthetic construct
  source 1..21: mol_type = other RNA
aacagttttccactatttctt

SEQ ID NO: 2356 - RNA, 21 nt, synthetic construct
  source 1..21: mol_type = other RNA
atatgtctttcatgatcttgt

SEQ ID NO: 2357 - RNA, 21 nt, synthetic construct
  source 1..21: mol_type = other RNA
accatcaaggttcactttagt

SEQ ID NO: 2358 - RNA, 21 nt, synthetic construct
  source 1..21: mol_type = other RNA
atcaaggttcactttagaaat

SEQ ID NO: 2359 - RNA, 21 nt, synthetic construct
  source 1..21: mol_type = other RNA
gttttctattcacttcaacgt

SEQ ID NO: 2360 - RNA, 21 nt, synthetic construct
  source 1..21: mol_type = other RNA
tgtcacatcagttctacaagt

SEQ ID NO: 2361 - RNA, 21 nt, synthetic construct
  source 1..21: mol_type = other RNA
catcatgaacactatcaatgt

SEQ ID NO: 2362 - RNA, 21 nt, synthetic construct
  source 1..21: mol_type = other RNA
gactcatatgagatttatcat

SEQ ID NO: 2363 - RNA, 21 nt, synthetic construct
  source 1..21: mol_type = other RNA
ctcggaaaattcatgattctt

SEQ ID NO: 2364 - RNA, 21 nt, synthetic construct
  source 1..21: mol_type = other RNA
tctaatcgaggatttcaactt

SEQ ID NO: 2365 - RNA, 21 nt, synthetic construct
  source 1..21: mol_type = other RNA
caaaatcctcaagaaaccttt

SEQ ID NO: 2366 - RNA, 21 nt, synthetic construct
  source 1..21: mol_type = other RNA
tcctcaagaaaccttagtaat

SEQ ID NO: 2367 - RNA, 21 nt, synthetic construct
  source 1..21: mol_type = other RNA
acccttcaacagaatatcatt

SEQ ID NO: 2368 - RNA, 21 nt, synthetic construct
  source 1..21: mol_type = other RNA
cccttcaacagaatatcattt

SEQ ID NO: 2369 - RNA, 21 nt, synthetic construct
  source 1..21: mol_type = other RNA
aaatccaaagaatacttcttt

SEQ ID NO: 2370 - RNA, 21 nt, synthetic construct
  source 1..21: mol_type = other RNA
aaagactactcaatcattcat

SEQ ID NO: 2371 - RNA, 21 nt, synthetic construct
  source 1..21: mol_type = other RNA
agactactcaatcattcattt

SEQ ID NO: 2372 - RNA, 21 nt, synthetic construct
  source 1..21: mol_type = other RNA
gactactcaatcattcattat

SEQ ID NO: 2373 - RNA, 21 nt, synthetic construct
  source 1..21: mol_type = other RNA
aacactctccaacatttcctt

SEQ ID NO: 2374 - RNA, 21 nt, synthetic construct
  source 1..21: mol_type = other RNA
gatgaagtcaactctactttt

SEQ ID NO: 2375 - RNA, 21 nt, synthetic construct
  source 1..21: mol_type = other RNA
agtcaactctactttcacctt

SEQ ID NO: 2376 - RNA, 21 nt, synthetic construct
  source 1..21: mol_type = other RNA
gacattagtcaaacatctttt

SEQ ID NO: 2377 - RNA, 21 nt, synthetic construct
  source 1..21: mol_type = other RNA
ccttcctcagacttaaatctt

SEQ ID NO: 2378 - RNA, 21 nt, synthetic construct
  source 1..21: mol_type = other RNA
tcagacttaaatctctttact

SEQ ID NO: 2379 - RNA, 21 nt, synthetic construct
  source 1..21: mol_type = other RNA
gaattggatcaaacaattatt

SEQ ID NO: 2380 - RNA, 21 nt, synthetic construct
  source 1..21: mol_type = other RNA
attaggtcattcagaaactct

SEQ ID NO: 2381 - RNA, 21 nt, synthetic construct
  source 1..21: mol_type = other RNA
gaagaagagtacaatcttact

SEQ ID NO: 2382 - RNA, 21 nt, synthetic construct
  source 1..21: mol_type = other RNA
ttcgaacacagatataattgt

SEQ ID NO: 2383 - RNA, 21 nt, synthetic construct
  source 1..21: mol_type = other RNA
aagcaaattactgcatcttct

SEQ ID NO: 2384 - RNA, 21 nt, synthetic construct
  source 1..21: mol_type = other RNA
tcattgttgcttcataaatct

SEQ ID NO: 2385 - RNA, 21 nt, synthetic construct
  source 1..21: mol_type = other RNA
taatcagaattcctcgaatgt

SEQ ID NO: 2386 - RNA, 21 nt, synthetic construct
  source 1..21: mol_type = other RNA
tctgaatctagtcagttattt

SEQ ID NO: 2387 - RNA, 21 nt, synthetic construct
  source 1..21: mol_type = other RNA
gaactgaatattcaaaaacct

SEQ ID NO: 2388 - RNA, 21 nt, synthetic construct
  source 1..21: mol_type = other RNA
atgcaaacgccatttcttata

SEQ ID NO: 2389 - RNA, 21 nt, synthetic construct
  source 1..21: mol_type = other RNA
atgcaatcgccatttcttata

SEQ ID NO: 2390 - RNA, 21 nt, synthetic construct
  source 1..21: mol_type = other RNA
atgcatacgccatttcttata

SEQ ID NO: 2391 - RNA, 21 nt, synthetic construct
  source 1..21: mol_type = other RNA
atgctaacgccatttcttata

SEQ ID NO: 2392 - RNA, 19 nt, synthetic construct
  source 1..19: mol_type = other RNA
gcaaacgccatttcttata

SEQ ID NO: 2393 - RNA, 19 nt, synthetic construct
  source 1..19: mol_type = other RNA
gcaaacgccatttcttatt

SEQ ID NO: 2394 - RNA, 21 nt, synthetic construct
  source 1..21: mol_type = other RNA
atgcaatcgccatttcttatt

SEQ ID NO: 2395 - RNA, 21 nt, synthetic construct
  source 1..21: mol_type = other RNA
atgcatacgccatttcttatt

SEQ ID NO: 2396 - RNA, 21 nt, synthetic construct
  source 1..21: mol_type = other RNA
atgctaacgccatttcttatt

SEQ ID NO: 2397 - RNA, 21 nt, synthetic construct
  source 1..21: mol_type = other RNA
atgcctcacacacatttattt

SEQ ID NO: 2398 - RNA, 21 nt, synthetic construct
  source 1..21: mol_type = other RNA
ctcacacacatctattattct

SEQ ID NO: 2399 - RNA, 21 nt, synthetic construct
  source 1..21: mol_type = other RNA
ctcacacacatctatttctct

SEQ ID NO: 2400 - RNA, 21 nt, synthetic construct
  source 1..21: mol_type = other RNA
aatgtacacagtcattggatt

SEQ ID NO: 2401 - RNA, 21 nt, synthetic construct
  source 1..21: mol_type = other RNA
gcaggcttacattgatattat

SEQ ID NO: 2402 - RNA, 21 nt, synthetic construct
  source 1..21: mol_type = other RNA
gcaggcttacattgtcattat

SEQ ID NO: 2403 - RNA, 21 nt, synthetic construct
  source 1..21: mol_type = other RNA
caggcttacattgactttaat

SEQ ID NO: 2404 - RNA, 21 nt, synthetic construct
  source 1..21: mol_type = other RNA
tacattgacattaaatactgt

SEQ ID NO: 2405 - RNA, 21 nt, synthetic construct
  source 1..21: mol_type = other RNA
tacattgacattaataactgt

SEQ ID NO: 2406 - RNA, 21 nt, synthetic construct
  source 1..21: mol_type = other RNA
cacctgtaataccagtgaatt

SEQ ID NO: 2407 - RNA, 21 nt, synthetic construct
  source 1..21: mol_type = other RNA
cacctgtaataccatcgaatt

SEQ ID NO: 2408 - RNA, 21 nt, synthetic construct
  source 1..21: mol_type = other RNA
tcggaattcttggtcttattt

SEQ ID NO: 2409 - RNA, 21 nt, synthetic construct
  source 1..21: mol_type = other RNA
tcggaattcttggttctattt

SEQ ID NO: 2410 - RNA, 21 nt, synthetic construct
  source 1..21: mol_type = other RNA
aaagaagagctggtattatgt

SEQ ID NO: 2411 - RNA, 21 nt, synthetic construct
  source 1..21: mol_type = other RNA
aaagaagagctggttctatgt

SEQ ID NO: 2412 - RNA, 21 nt, synthetic construct
  source 1..21: mol_type = other RNA
taagcactggtatcttatctt

SEQ ID NO: 2413 - RNA, 21 nt, synthetic construct
  source 1..21: mol_type = other RNA
ctgctataccacagatttctt

SEQ ID NO: 2414 - RNA, 21 nt, synthetic construct
  source 1..21: mol_type = other RNA
ctgctataccacagtgttctt

SEQ ID NO: 2415 - RNA, 21 nt, synthetic construct
  source 1..21: mol_type = other RNA
agagttctatgtagtttacat

SEQ ID NO: 2416 - RNA, 21 nt, synthetic construct
  source 1..21: mol_type = other RNA
tctatgtagcttacatttcct

SEQ ID NO: 2417 - RNA, 21 nt, synthetic construct
  source 1..21: mol_type = other RNA
tctatgtagcttactgttcct

SEQ ID NO: 2418 - RNA, 21 nt, synthetic construct
  source 1..21: mol_type = other RNA
ctattgtggctagatttattt

SEQ ID NO: 2419 - RNA, 21 nt, synthetic construct
  source 1..21: mol_type = other RNA
tccatggtggacaagtttttt

SEQ ID NO: 2420 - RNA, 21 nt, synthetic construct
  source 1..21: mol_type = other RNA
tccatggtggacaatattttt

SEQ ID NO: 2421 - RNA, 21 nt, synthetic construct
  source 1..21: mol_type = other RNA
aagatttttgaaggatatact

SEQ ID NO: 2422 - RNA, 21 nt, synthetic construct
  source 1..21: mol_type = other RNA
aagatttttgaaggtaatact

SEQ ID NO: 2423 - RNA, 21 nt, synthetic construct
  source 1..21: mol_type = other RNA
agatttttgaaggaattactt

SEQ ID NO: 2424 - RNA, 21 nt, synthetic construct
  source 1..21: mol_type = other RNA
agatttttgaaggatatactt

SEQ ID NO: 2425 - RNA, 23 nt, synthetic construct
  source 1..23: mol_type = other RNA
actagaattcatggaagttaaca

SEQ ID NO: 2426 - RNA, 23 nt, synthetic construct
  source 1..23: mol_type = other RNA
aagaattgagaactgagttcttg

SEQ ID NO: 2427 - RNA, 23 nt, synthetic construct
  source 1..23: mol_type = other RNA
aaagtatcattgagagtaggaga

SEQ ID NO: 2428 - RNA, 23 nt, synthetic construct
  source 1..23: mol_type = other RNA
agaacacgattttgagtgtgtct

SEQ ID NO: 2429 - RNA, 23 nt, synthetic construct
  source 1..23: mol_type = other RNA
atagaattcatggaagttaacat

SEQ ID NO: 2430 - RNA, 23 nt, synthetic construct
  source 1..23: mol_type = other RNA
aaaaagtatcattgagagtagga

SEQ ID NO: 2431 - RNA, 23 nt, synthetic construct
  source 1..23: mol_type = other RNA
aagaaatagtggaaaactgttaa

SEQ ID NO: 2432 - RNA, 23 nt, synthetic construct
  source 1..23: mol_type = other RNA
acaagatcatgaaagacatatag

SEQ ID NO: 2433 - RNA, 23 nt, synthetic construct
  source 1..23: mol_type = other RNA
actaaagtgaaccttgatggtgt

SEQ ID NO: 2434 - RNA, 23 nt, synthetic construct
  source 1..23: mol_type = other RNA
atttctaaagtgaaccttgatgg

SEQ ID NO: 2435 - RNA, 23 nt, synthetic construct
  source 1..23: mol_type = other RNA
acgttgaagtgaatagaaaacaa

SEQ ID NO: 2436 - RNA, 23 nt, synthetic construct
  source 1..23: mol_type = other RNA
acttgtagaactgatgtgacagc

SEQ ID NO: 2437 - RNA, 23 nt, synthetic construct
  source 1..23: mol_type = other RNA
acattgatagtgttcatgatgtt

SEQ ID NO: 2438 - RNA, 23 nt, synthetic construct
  source 1..23: mol_type = other RNA
atgataaatctcatatgagtctt

SEQ ID NO: 2439 - RNA, 23 nt, synthetic construct
  source 1..23: mol_type = other RNA
aagaatcatgaattttccgagtt

SEQ ID NO: 2440 - RNA, 23 nt, synthetic construct
  source 1..23: mol_type = other RNA
aagttgaaatcctcgattagatt

SEQ ID NO: 2441 - RNA, 23 nt, synthetic construct
  source 1..23: mol_type = other RNA
aaaggtttcttgaggattttgag

SEQ ID NO: 2442 - RNA, 23 nt, synthetic construct
  source 1..23: mol_type = other RNA
attactaaggtttcttgaggatt

SEQ ID NO: 2443 - RNA, 23 nt, synthetic construct
  source 1..23: mol_type = other RNA
aatgatattctgttgaagggttg

SEQ ID NO: 2444 - RNA, 23 nt, synthetic construct
  source 1..23: mol_type = other RNA
aaatgatattctgttgaagggtt

SEQ ID NO: 2445 - RNA, 23 nt, synthetic construct
  source 1..23: mol_type = other RNA
aaagaagtattctttggatttga

SEQ ID NO: 2446 - RNA, 23 nt, synthetic construct
  source 1..23: mol_type = other RNA
atgaatgattgagtagtcttttc

SEQ ID NO: 2447 - RNA, 23 nt, synthetic construct
  source 1..23: mol_type = other RNA
aaatgaatgattgagtagtcttt

SEQ ID NO: 2448 - RNA, 23 nt, synthetic construct
  source 1..23: mol_type = other RNA
ataatgaatgattgagtagtctt

SEQ ID NO: 2449 - RNA, 23 nt, synthetic construct
  source 1..23: mol_type = other RNA
aaggaaatgttggagagtgttcc

SEQ ID NO: 2450 - RNA, 23 nt, synthetic construct
  source 1..23: mol_type = other RNA
aaaagtagagttgacttcatctt

SEQ ID NO: 2451 - RNA, 23 nt, synthetic construct
  source 1..23: mol_type = other RNA
aaggtgaaagtagagttgacttc

SEQ ID NO: 2452 - RNA, 23 nt, synthetic construct
  source 1..23: mol_type = other RNA
aaaagatgtttgactaatgtcat

SEQ ID NO: 2453 - RNA, 23 nt, synthetic construct
  source 1..23: mol_type = other RNA
aagatttaagtctgaggaaggga

SEQ ID NO: 2454 - RNA, 23 nt, synthetic construct
  source 1..23: mol_type = other RNA
agtaaagagatttaagtctgagg

SEQ ID NO: 2455 - RNA, 23 nt, synthetic construct
  source 1..23: mol_type = other RNA
aataattgtttgatccaattctg

SEQ ID NO: 2456 - RNA, 23 nt, synthetic construct
  source 1..23: mol_type = other RNA
agagtttctgaatgacctaattc

SEQ ID NO: 2457 - RNA, 23 nt, synthetic construct
  source 1..23: mol_type = other RNA
agtaagattgtactcttcttctt

SEQ ID NO: 2458 - RNA, 23 nt, synthetic construct
  source 1..23: mol_type = other RNA
acaattatatctgtgttcgaaga

SEQ ID NO: 2459 - RNA, 23 nt, synthetic construct
  source 1..23: mol_type = other RNA
agaagatgcagtaatttgcttgt

SEQ ID NO: 2460 - RNA, 23 nt, synthetic construct
  source 1..23: mol_type = other RNA
agatttatgaagcaacaatgaat

SEQ ID NO: 2461 - RNA, 23 nt, synthetic construct
  source 1..23: mol_type = other RNA
acattcgaggaattctgattatg

SEQ ID NO: 2462 - RNA, 23 nt, synthetic construct
  source 1..23: mol_type = other RNA
aaataactgactagattcagaag

SEQ ID NO: 2463 - RNA, 23 nt, synthetic construct
  source 1..23: mol_type = other RNA
aggtttttgaatattcagttcta

SEQ ID NO: 2464 - RNA, 23 nt, synthetic construct
  source 1..23: mol_type = other RNA
  modified_base 7: mod_base = OTHER; note = 5'-methyluridine-3'-phosphate
aatagatgtgtgtgaggcatgga

SEQ ID NO: 2465 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
atttcatgggagtaatagatgtg

SEQ ID NO: 2466 - RNA, 23 nt, synthetic construct
  source 1..23: mol_type = other RNA
  modified_base 5: mod_base = OTHER; note = 5'-methyluridine-3'-phosphate
aagttgaaatcctcgatcagatt

SEQ ID NO: 2467 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
atcaaacgtcttctgtgtcccac

SEQ ID NO: 2468 - RNA, 23 nt, synthetic construct
  source 1..23: mol_type = other RNA
  modified_base 12: mod_base = OTHER; note = 5'-methyluridine-3'-phosphate
agtcaaacgtcttctgtgtccca

SEQ ID NO: 2469 - RNA, 23 nt, synthetic construct
  source 1..23: mol_type = other RNA
  modified_base 2: mod_base = OTHER; note = 5'-methyluridine-3'-phosphate
atgtcaaacgtcttctgtgtccc

SEQ ID NO: 2470 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
atttgcttgtcaaacgtcttctg

SEQ ID NO: 2471 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
aacgatttgcttgtcaaacgtct

SEQ ID NO: 2472 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
acacgatttgcttgtcaaacgtc

SEQ ID NO: 2473 - RNA, 23 nt, synthetic construct
  source 1..23: mol_type = other RNA
  modified_base 5: mod_base = OTHER; note = 5'-methyluridine-3'-phosphate
acattgactgtgtacattaggga

SEQ ID NO: 2474 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
accattgactgtgtacattaggg

SEQ ID NO: 2475 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
atccattgactgtgtacattagg

SEQ ID NO: 2476 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
atgaaatgaatggagaataattc

SEQ ID NO: 2477 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 7: mod_base = OTHER; note = 5'-methyluridine-3'-phosphate
atattttcttaagattcctggtt

SEQ ID NO: 2478 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
agtattacaggtgcatagtccca

SEQ ID NO: 2479 - RNA, 23 nt, synthetic construct
  source 1..23: mol_type = other RNA
  modified_base 7: mod_base = OTHER; note = 5'-methyluridine-3'-phosphate
aggtattacaggtgcatagtccc

SEQ ID NO: 2480 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 7: mod_base = OTHER; note = 5'-methyluridine-3'-phosphate
atggtattacaggtgcatagtcc

SEQ ID NO: 2481 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
attcgctggtattacaggtgcat

SEQ ID NO: 2482 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
atattcgctggtattacaggtgc

SEQ ID NO: 2483 - RNA, 23 nt, synthetic construct
  source 1..23: mol_type = other RNA
  modified_base 5: mod_base = OTHER; note = 5'-methyluridine-3'-phosphate
aatattcgctggtattacaggtg

SEQ ID NO: 2484 - RNA, 23 nt, synthetic construct
  source 1..23: mol_type = other RNA
  modified_base 7: mod_base = OTHER; note = 5'-methyluridine-3'-phosphate
acatattcgctggtattacaggt

SEQ ID NO: 2485 - RNA, 23 nt, synthetic construct
  source 1..23: mol_type = other RNA
  modified_base 7: mod_base = OTHER; note = 5'-methyluridine-3'-phosphate
agtccatattcgctggtattaca

SEQ ID NO: 2486 - RNA, 23 nt, synthetic construct
  source 1..23: mol_type = other RNA
  modified_base 7: mod_base = OTHER; note = 5'-methyluridine-3'-phosphate
aagaaattatccaaatgctgaga

SEQ ID NO: 2487 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
attgaacacgattttgagtgtgt

SEQ ID NO: 2488 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
acctctttccatagatgaatgag

SEQ ID NO: 2489 - RNA, 23 nt, synthetic construct
  source 1..23: mol_type = other RNA
  modified_base 5: mod_base = OTHER; note = 5'-methyluridine-3'-phosphate
aagttaacatccaagttccaaca

SEQ ID NO: 2490 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
agattcaatgatgagtttcggaa

SEQ ID NO: 2491 - RNA, 23 nt, synthetic construct
  source 1..23: mol_type = other RNA
  modified_base 7: mod_base = OTHER; note = 5'-methyluridine-3'-phosphate
aacaattatatctgtgtttgaag

SEQ ID NO: 2492 - RNA, 23 nt, synthetic construct
  source 1..23: mol_type = other RNA
  modified_base 12: mod_base = OTHER; note = 5'-methyluridine-3'-phosphate
agaagaataatttgaaccaacaa

SEQ ID NO: 2493 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
aaaatcttagatgagttactttg

SEQ ID NO: 2494 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
aagatttatgtctaactctagga

SEQ ID NO: 2495 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
atttcgtgtcttaatgagaaact

SEQ ID NO: 2496 - RNA, 23 nt, synthetic construct
  source 1..23: mol_type = other RNA
  modified_base 12: mod_base = OTHER; note = 5'-methyluridine-3'-phosphate
aaagagatgtttcattggattta

SEQ ID NO: 2497 - RNA, 23 nt, synthetic construct
  source 1..23: mol_type = other RNA
  modified_base 5: mod_base = OTHER; note = 5'-methyluridine-3'-phosphate
aggattaaattcctttgatagaa

SEQ ID NO: 2498 - RNA, 23 nt, synthetic construct
  source 1..23: mol_type = other RNA
  modified_base 12: mod_base = OTHER; note = 5'-methyluridine-3'-phosphate
aataatcaatttcagcatagtca

SEQ ID NO: 2499 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
atgtaataatttcttctgtttcc

SEQ ID NO: 2500 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
atcacgtttggtaaaagtgctgt

SEQ ID NO: 2501 - RNA, 23 nt, synthetic construct
  source 1..23: mol_type = other RNA
  modified_base 2: mod_base = OTHER; note = 5'-methyluridine-3'-phosphate
atttaaaacgaacttggataaca

SEQ ID NO: 2502 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
agctatttggctgaacagcatta

SEQ ID NO: 2503 - RNA, 23 nt, synthetic construct
  source 1..23: mol_type = other RNA
  modified_base 7: mod_base = OTHER; note = 5'-methyluridine-3'-phosphate
aatacgtaggtataactgctatt

SEQ ID NO: 2504 - RNA, 23 nt, synthetic construct
  source 1..23: mol_type = other RNA
  modified_base 5: mod_base = OTHER; note = 5'-methyluridine-3'-phosphate
aaagtgaaccacgtgaatgtctt

SEQ ID NO: 2505 - RNA, 23 nt, synthetic construct
  source 1..23: mol_type = other RNA
  modified_base 7: mod_base = OTHER; note = 5'-methyluridine-3'-phosphate
aaagagttttaaatgaaccaggc

SEQ ID NO: 2506 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
atggcgtttgcatccctgctctc

SEQ ID NO: 2507 - RNA, 23 nt, synthetic construct
  source 1..23: mol_type = other RNA
  modified_base 12: mod_base = OTHER; note = 5'-methyluridine-3'-phosphate
agaaatggcgtttgcatccctgc

SEQ ID NO: 2508 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
aagaaatggcgtttgcatccctg

SEQ ID NO: 2509 - RNA, 23 nt, synthetic construct
  source 1..23: mol_type = other RNA
  modified_base 2: mod_base = OTHER; note = 5'-methyluridine-3'-phosphate
ataagaaatggcgtttgcatccc

SEQ ID NO: 2510 - RNA, 23 nt, synthetic construct
  source 1..23: mol_type = other RNA
  modified_base 7: mod_base = OTHER; note = 5'-methyluridine-3'-phosphate
acatgataagaaatggcgtttgc

SEQ ID NO: 2511 - RNA, 23 nt, synthetic construct
  source 1..23: mol_type = other RNA
  modified_base 5: mod_base = OTHER; note = 5'-methyluridine-3'-phosphate
accatgataagaaatggcgtttg

SEQ ID NO: 2512 - RNA, 23 nt, synthetic construct
  source 1..23: mol_type = other RNA
  modified_base 2: mod_base = OTHER; note = 5'-methyluridine-3'-phosphate
atccatgataagaaatggcgttt

SEQ ID NO: 2513 - RNA, 23 nt, synthetic construct
  source 1..23: mol_type = other RNA
  modified_base 7: mod_base = OTHER; note = 5'-methyluridine-3'-phosphate
agtccatgataagaaatggcgtt

SEQ ID NO: 2514 - RNA, 23 nt, synthetic construct
  source 1..23: mol_type = other RNA
  modified_base 12: mod_base = OTHER; note = 5'-methyluridine-3'-phosphate
aataccagtgcttagtcccattg

SEQ ID NO: 2515 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
atgataccagtgcttagtcccat

SEQ ID NO: 2516 - RNA, 23 nt, synthetic construct
  source 1..23: mol_type = other RNA
  modified_base 12: mod_base = OTHER; note = 5'-methyluridine-3'-phosphate
aatgataccagtgcttagtccca

SEQ ID NO: 2517 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
atcagatatgataccagtgctta

SEQ ID NO: 2518 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
agtgaatcagatatgataccagt

SEQ ID NO: 2519 - RNA, 23 nt, synthetic construct
  source 1..23: mol_type = other RNA
  modified_base 5: mod_base = OTHER; note = 5'-methyluridine-3'-phosphate
acagtaacccagaaactctgaag

SEQ ID NO: 2520 - RNA, 23 nt, synthetic construct
  source 1..23: mol_type = other RNA
  modified_base 7: mod_base = OTHER; note = 5'-methyluridine-3'-phosphate
aaaggtttagaggcaaattctgc

SEQ ID NO: 2521 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
atagaactctgtggtatagcagg

SEQ ID NO: 2522 - RNA, 23 nt, synthetic construct
  source 1..23: mol_type = other RNA
  modified_base 12: mod_base = OTHER; note = 5'-methyluridine-3'-phosphate
acatagaactctgtggtatagca

SEQ ID NO: 2523 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
atacatagaactctgtggtatag

SEQ ID NO: 2524 - RNA, 23 nt, synthetic construct
  source 1..23: mol_type = other RNA
  modified_base 2: mod_base = OTHER; note = 5'-methyluridine-3'-phosphate
atgtaagctacatagaactctgt

SEQ ID NO: 2525 - RNA, 23 nt, synthetic construct
  source 1..23: mol_type = other RNA
  modified_base 5: mod_base = OTHER; note = 5'-methyluridine-3'-phosphate
actgtaagctacatagaactctg

SEQ ID NO: 2526 - RNA, 23 nt, synthetic construct
  source 1..23: mol_type = other RNA
  modified_base 2: mod_base = OTHER; note = 5'-methyluridine-3'-phosphate
atggaactgtaagctacatagaa

SEQ ID NO: 2527 - RNA, 23 nt, synthetic construct
  source 1..23: mol_type = other RNA
  modified_base 2: mod_base = OTHER; note = 5'-methyluridine-3'-phosphate
attggaactgtaagctacataga

SEQ ID NO: 2528 - RNA, 23 nt, synthetic construct
  source 1..23: mol_type = other RNA
  modified_base 7: mod_base = OTHER; note = 5'-methyluridine-3'-phosphate
actggttggaactgtaagctaca

SEQ ID NO: 2529 - RNA, 23 nt, synthetic construct
  source 1..23: mol_type = other RNA
  modified_base 5: mod_base = OTHER; note = 5'-methyluridine-3'-phosphate
acattaaaatacatcacattcct

SEQ ID NO: 2530 - RNA, 23 nt, synthetic construct
  source 1..23: mol_type = other RNA
  modified_base 2: mod_base = OTHER; note = 5'-methyluridine-3'-phosphate
atatatctagccacaataggtgg

SEQ ID NO: 2531 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
aatatatctagccacaataggtg

SEQ ID NO: 2532 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 7: mod_base = OTHER; note = 5'-methyluridine-3'-phosphate
ataatatatctagccacaatagg

SEQ ID NO: 2533 - RNA, 23 nt, synthetic construct
  source 1..23: mol_type = other RNA
  modified_base 12: mod_base = OTHER; note = 5'-methyluridine-3'-phosphate
actaatatatctagccacaatag

SEQ ID NO: 2534 - RNA, 23 nt, synthetic construct
  source 1..23: mol_type = other RNA
  modified_base 7: mod_base = OTHER; note = 5'-methyluridine-3'-phosphate
acctaatatatctagccacaata

SEQ ID NO: 2535 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
atcctaatatatctagccacaat

SEQ ID NO: 2536 - RNA, 23 nt, synthetic construct
  source 1..23: mol_type = other RNA
  modified_base 12: mod_base = OTHER; note = 5'-methyluridine-3'-phosphate
agagatcctaatatatctagcca

SEQ ID NO: 2537 - RNA, 23 nt, synthetic construct
  source 1..23: mol_type = other RNA
  modified_base 5: mod_base = OTHER; note = 5'-methyluridine-3'-phosphate
actttacatacatttcagaggac

SEQ ID NO: 2538 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
aactgttaacatttaacacagcg

SEQ ID NO: 2539 - RNA, 23 nt, synthetic construct
  source 1..23: mol_type = other RNA
tataagaaatggcgtttgcatcc

SEQ ID NO: 2540 - RNA, 23 nt, synthetic construct
  source 1..23: mol_type = other RNA
  modified_base 10: mod_base = OTHER; note = 5'-methyluridine-3'-phosphate
tataagaaatggcgtttgcatcc

SEQ ID NO: 2541 - RNA, 23 nt, synthetic construct
  source 1..23: mol_type = other RNA
  modified_base 10: mod_base = OTHER; note = 5'-methyluridine-3'-phosphate
tataagaaatggcgattgcatcc

SEQ ID NO: 2542 - RNA, 23 nt, synthetic construct
  source 1..23: mol_type = other RNA
  modified_base 10: mod_base = OTHER; note = 5'-methyluridine-3'-phosphate
tataagaaatggcgtatgcatcc

SEQ ID NO: 2543 - RNA, 23 nt, synthetic construct
  source 1..23: mol_type = other RNA
  modified_base 10: mod_base = OTHER; note = 5'-methyluridine-3'-phosphate
tataagaaatggcgttagcatcc

SEQ ID NO: 2544 - RNA, 21 nt, synthetic construct
  source 1..21: mol_type = other RNA
  modified_base 10: mod_base = OTHER; note = 5'-methyluridine-3'-phosphate
tataagaaatggcgtttgcgt

SEQ ID NO: 2545 - RNA, 21 nt, synthetic construct
  source 1..21: mol_type = other RNA
aataagaaatggcgtttgcgt

SEQ ID NO: 2546 - RNA, 23 nt, synthetic construct
  source 1..23: mol_type = other RNA
aataagaaatggcgattgcatcc

SEQ ID NO: 2547 - RNA, 23 nt, synthetic construct
  source 1..23: mol_type = other RNA
aataagaaatggcgtatgcatcc

SEQ ID NO: 2548 - RNA, 23 nt, synthetic construct
  source 1..23: mol_type = other RNA
aataagaaatggcgttagcatcc

SEQ ID NO: 2549 - RNA, 21 nt, synthetic construct
  source 1..21: mol_type = other RNA
tataagaaatggcgtttgcgt

SEQ ID NO: 2550 - RNA, 23 nt, synthetic construct
  source 1..23: mol_type = other RNA
tataagaaatggcgtatgcatcc

SEQ ID NO: 2551 - RNA, 23 nt, synthetic construct
  source 1..23: mol_type = other RNA
  modified_base 12: mod_base = OTHER; note = 5'-methyluridine-3'-phosphate
aaataaatgtgtgtgaggcatgg

SEQ ID NO: 2552 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
agaataatagatgtgtgtgaggc

SEQ ID NO: 2553 - RNA, 23 nt, synthetic construct
  source 1..23: mol_type = other RNA
  modified_base 12: mod_base = OTHER; note = 5'-methyluridine-3'-phosphate
agagaaatagatgtgtgtgaggc

SEQ ID NO: 2554 - RNA, 23 nt, synthetic construct
  source 1..23: mol_type = other RNA
  modified_base 12: mod_base = OTHER; note = 5'-methyluridine-3'-phosphate
aatccaatgactgtgtacattag

SEQ ID NO: 2555 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 7: mod_base = OTHER; note = 5'-methyluridine-3'-phosphate
ataatgtcaatgtaagcctgcat

SEQ ID NO: 2556 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 7: mod_base = OTHER; note = 5'-methyluridine-3'-phosphate
ataatatcaatgtaagcctgcat

SEQ ID NO: 2557 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
ataatgacaatgtaagcctgcat

SEQ ID NO: 2558 - RNA, 23 nt, synthetic construct
  source 1..23: mol_type = other RNA
attaaagtcaatgtaagcctgca

SEQ ID NO: 2559 - RNA, 23 nt, synthetic construct
  source 1..23: mol_type = other RNA
attaatatcaatgtaagcctgca

SEQ ID NO: 2560 - RNA, 23 nt, synthetic construct
  source 1..23: mol_type = other RNA
attaatgtcaatgtaagcctgcg

SEQ ID NO: 2561 - RNA, 23 nt, synthetic construct
  source 1..23: mol_type = other RNA
attaaagtcaatgtaagcctgcg

SEQ ID NO: 2562 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
acagtatttaatgtcaatgtaag

SEQ ID NO: 2563 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
acagttattaatgtcaatgtaag

SEQ ID NO: 2564 - RNA, 23 nt, synthetic construct
  source 1..23: mol_type = other RNA
aattcactggtattacaggtgca

SEQ ID NO: 2565 - RNA, 23 nt, synthetic construct
  source 1..23: mol_type = other RNA
aattcgatggtattacaggtgca

SEQ ID NO: 2566 - RNA, 23 nt, synthetic construct
  source 1..23: mol_type = other RNA
aattcactggtattacaggtgcg

SEQ ID NO: 2567 - RNA, 23 nt, synthetic construct
  source 1..23: mol_type = other RNA
aattcgatggtattacaggtgcg

SEQ ID NO: 2568 - RNA, 23 nt, synthetic construct
  source 1..23: mol_type = other RNA
aaataagaccaagaattccgaga

SEQ ID NO: 2569 - RNA, 23 nt, synthetic construct
  source 1..23: mol_type = other RNA
aaatagaaccaagaattccgaga

SEQ ID NO: 2570 - RNA, 23 nt, synthetic construct
  source 1..23: mol_type = other RNA
aaataggaccaagaattccgagg

SEQ ID NO: 2571 - RNA, 23 nt, synthetic construct
  source 1..23: mol_type = other RNA
aaataagaccaagaattccgagg

SEQ ID NO: 2572 - RNA, 23 nt, synthetic construct
  source 1..23: mol_type = other RNA
aaatagaaccaagaattccgagg

SEQ ID NO: 2573 - RNA, 23 nt, synthetic construct
  source 1..23: mol_type = other RNA
  modified_base 7: mod_base = OTHER; note = 5'-methyluridine-3'-phosphate
acataataccagctcttcttttc

SEQ ID NO: 2574 - RNA, 23 nt, synthetic construct
  source 1..23: mol_type = other RNA
acatagaaccagctcttcttttc

SEQ ID NO: 2575 - RNA, 23 nt, synthetic construct
  source 1..23: mol_type = other RNA
  modified_base 5: mod_base = OTHER; note = 5'-methyluridine-3'-phosphate
aagataagataccagtgcttagt

SEQ ID NO: 2576 - RNA, 23 nt, synthetic construct
  source 1..23: mol_type = other RNA
  modified_base 7: mod_base = OTHER; note = 5'-methyluridine-3'-phosphate
aagaaatctgtggtatagcagga

SEQ ID NO: 2577 - RNA, 23 nt, synthetic construct
  source 1..23: mol_type = other RNA
aagaacactgtggtatagcagga

SEQ ID NO: 2578 - RNA, 23 nt, synthetic construct
  source 1..23: mol_type = other RNA
  modified_base 7: mod_base = OTHER; note = 5'-methyluridine-3'-phosphate
aagaactctgtggtatagcaggg

SEQ ID NO: 2579 - RNA, 23 nt, synthetic construct
  source 1..23: mol_type = other RNA
  modified_base 7: mod_base = OTHER; note = 5'-methyluridine-3'-phosphate
aagaaatctgtggtatagcaggg

SEQ ID NO: 2580 - RNA, 23 nt, synthetic construct
  source 1..23: mol_type = other RNA
aagaacactgtggtatagcaggg

SEQ ID NO: 2581 - RNA, 23 nt, synthetic construct
  source 1..23: mol_type = other RNA
  modified_base 2: mod_base = OTHER; note = 5'-methyluridine-3'-phosphate
atgtaaactacatagaactctgt

SEQ ID NO: 2582 - RNA, 23 nt, synthetic construct
  source 1..23: mol_type = other RNA
  modified_base 7: mod_base = OTHER; note = 5'-methyluridine-3'-phosphate
aggaaatgtaagctacatagaac

SEQ ID NO: 2583 - RNA, 23 nt, synthetic construct
  source 1..23: mol_type = other RNA
aggaacagtaagctacatagaac

SEQ ID NO: 2584 - RNA, 23 nt, synthetic construct
  source 1..23: mol_type = other RNA
aaataaatctagccacaataggt

SEQ ID NO: 2585 - RNA, 23 nt, synthetic construct
  source 1..23: mol_type = other RNA
aaaaaacttgtccaccatggagg

SEQ ID NO: 2586 - RNA, 23 nt, synthetic construct
  source 1..23: mol_type = other RNA
aaaaatattgtccaccatggagg

SEQ ID NO: 2587 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
agtatatccttcaaaaatcttgt

SEQ ID NO: 2588 - RNA, 23 nt, synthetic construct
  source 1..23: mol_type = other RNA
  modified_base 5: mod_base = OTHER; note = 5'-methyluridine-3'-phosphate
agtattaccttcaaaaatcttgt

SEQ ID NO: 2589 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
aagtaattccttcaaaaatcttg

SEQ ID NO: 2590 - RNA, 23 nt, synthetic construct
  source 1..23: mol_type = other RNA
  modified_base 12: mod_base = OTHER; note = 5'-methyluridine-3'-phosphate
aagtatatccttcaaaaatcttg

SEQ ID NO: 2591 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttaacttccatgaattctagt

SEQ ID NO: 2592 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaactcagttctcaattctt

SEQ ID NO: 2593 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcctactctcaatgatacttt

SEQ ID NO: 2594 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acacactcaaaatcgtgttct

SEQ ID NO: 2595 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttaacttccatgaattctat

SEQ ID NO: 2596 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctactctcaatgatacttttt

SEQ ID NO: 2597 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagttttccactatttctt

SEQ ID NO: 2598 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atatgtctttcatgatcttgt

SEQ ID NO: 2599 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accatcaaggttcactttagt

SEQ ID NO: 2600 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcaaggttcactttagaaat

SEQ ID NO: 2601 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttttctattcacttcaacgt

SEQ ID NO: 2602 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtcacatcagttctacaagt

SEQ ID NO: 2603 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catcatgaacactatcaatgt

SEQ ID NO: 2604 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactcatatgagatttatcat

SEQ ID NO: 2605 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctcggaaaattcatgattctt

SEQ ID NO: 2606 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctaatcgaggatttcaactt

SEQ ID NO: 2607 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaaatcctcaagaaaccttt

SEQ ID NO: 2608 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcctcaagaaaccttagtaat

SEQ ID NO: 2609 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acccttcaacagaatatcatt

SEQ ID NO: 2610 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cccttcaacagaatatcattt

SEQ ID NO: 2611 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatccaaagaatacttcttt

SEQ ID NO: 2612 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagactactcaatcattcat

SEQ ID NO: 2613 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agactactcaatcattcattt

SEQ ID NO: 2614 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactactcaatcattcattat

SEQ ID NO: 2615 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacactctccaacatttcctt

SEQ ID NO: 2616 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatgaagtcaactctactttt

SEQ ID NO: 2617 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtcaactctactttcacctt

SEQ ID NO: 2618 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacattagtcaaacatctttt

SEQ ID NO: 2619 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccttcctcagacttaaatctt

SEQ ID NO: 2620 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcagacttaaatctctttact

SEQ ID NO: 2621 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaattggatcaaacaattatt

SEQ ID NO: 2622 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attaggtcattcagaaactct

SEQ ID NO: 2623 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagaagagtacaatcttact

SEQ ID NO: 2624 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcgaacacagatataattgt

SEQ ID NO: 2625 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagcaaattactgcatcttct

SEQ ID NO: 2626 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcattgttgcttcataaatct

SEQ ID NO: 2627 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taatcagaattcctcgaatgt

SEQ ID NO: 2628 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctgaatctagtcagttattt

SEQ ID NO: 2629 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaactgaatattcaaaaacct

SEQ ID NO: 2630 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccacaaactcaagtttgaatt

SEQ ID NO: 2631 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctttctgtaacttcctttt

SEQ ID NO: 2632 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtatgaaccatattttaagt

SEQ ID NO: 2633 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctaccatttcaggacttcttt

SEQ ID NO: 2634 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catgcctcacacacatctatt

SEQ ID NO: 2635 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcacacacatctattactcct

SEQ ID NO: 2636 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catctattactcccatgaaat

SEQ ID NO: 2637 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctgatcgaggatttcaactt

SEQ ID NO: 2638 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggacacagaagacgtttgat

SEQ ID NO: 2639 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggacacagaagacgtttgact

SEQ ID NO: 2640 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacacagaagacgtttgacat

SEQ ID NO: 2641 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagacgtttgacaagcaaat

SEQ ID NO: 2642 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acgtttgacaagcaaatcgtt

SEQ ID NO: 2643 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgtttgacaagcaaatcgtgt

SEQ ID NO: 2644 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtttgacaagcaaatcgtgct

SEQ ID NO: 2645 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttgacaagcaaatcgtgctt

SEQ ID NO: 2646 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctaatgtacacagtcaatgt

SEQ ID NO: 2647 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctaatgtacacagtcaatggt

SEQ ID NO: 2648 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taatgtacacagtcaatggat

SEQ ID NO: 2649 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attattctccattcatttcat

SEQ ID NO: 2650 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagtggatcatatcttctct

SEQ ID NO: 2651 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaggaatcttaagaaaatat

SEQ ID NO: 2652 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggactatgcacctgtaatact

SEQ ID NO: 2653 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactatgcacctgtaatacct

SEQ ID NO: 2654 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actatgcacctgtaataccat

SEQ ID NO: 2655 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctatgcacctgtaataccagt

SEQ ID NO: 2656 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcacctgtaataccagcgaat

SEQ ID NO: 2657 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acctgtaataccagcgaatat

SEQ ID NO: 2658 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctgtaataccagcgaatatt

SEQ ID NO: 2659 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtaataccagcgaatatgt

SEQ ID NO: 2660 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taataccagcgaatatggact

SEQ ID NO: 2661 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcagcatttggataatttctt

SEQ ID NO: 2662 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acactcaaaatcgtgttcaat

SEQ ID NO: 2663 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taagtggaacatcttagagtt

SEQ ID NO: 2664 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taacaagaccatactacagtt

SEQ ID NO: 2665 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cattcatctatggaaagaggt

SEQ ID NO: 2666 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttggaacttggatgttaactt

SEQ ID NO: 2667 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taacttccatgaattctagtt

SEQ ID NO: 2668 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccgaaactcatcattgaatct

SEQ ID NO: 2669 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaaacacagatataattgtt

SEQ ID NO: 2670 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttggttcaaattattcttct

SEQ ID NO: 2671 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actcagttctcaattcttcct

SEQ ID NO: 2672 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacgtctactttcacttggtt

SEQ ID NO: 2673 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagtaactcatctaagatttt

SEQ ID NO: 2674 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctagagttagacataaatctt

SEQ ID NO: 2675 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttctcattaagacacgaaat

SEQ ID NO: 2676 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaagcctacaacacattttt

SEQ ID NO: 2677 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatccaatgaaacatctcttt

SEQ ID NO: 2678 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaaatgcactctacttcagt

SEQ ID NO: 2679 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tactctcaatgatacttttct

SEQ ID NO: 2680 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctatcaaaggaatttaatcct

SEQ ID NO: 2681 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actatgctgaaattgattatt

SEQ ID NO: 2682 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaacagaagaaattattacat

SEQ ID NO: 2683 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcacttttaccaaacgtgat

SEQ ID NO: 2684 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatccaagttcgttttaaat

SEQ ID NO: 2685 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgctgttcagccaaatagct

SEQ ID NO: 2686 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagcagttatacctacgtatt

SEQ ID NO: 2687 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacattcacgtggttcacttt

SEQ ID NO: 2688 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggttcatttaaaactcttt

SEQ ID NO: 2689 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcagggatgcaaacgccat

SEQ ID NO: 2690 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcagggatgcaaacgccatt

SEQ ID NO: 2691 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agggatgcaaacgccatttct

SEQ ID NO: 2692 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggatgcaaacgccatttctt

SEQ ID NO: 2693 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggatgcaaacgccatttcttt

SEQ ID NO: 2694 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatgcaaacgccatttcttat

SEQ ID NO: 2695 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcaaacgccatttcttatct

SEQ ID NO: 2696 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaacgccatttcttatcatt

SEQ ID NO: 2697 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaacgccatttcttatcatgt

SEQ ID NO: 2698 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacgccatttcttatcatggt

SEQ ID NO: 2699 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acgccatttcttatcatggat

SEQ ID NO: 2700 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgccatttcttatcatggact

SEQ ID NO: 2701 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgggactaagcactggtatt

SEQ ID NO: 2702 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggactaagcactggtatct

SEQ ID NO: 2703 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggactaagcactggtatcat

SEQ ID NO: 2704 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggactaagcactggtatcatt

SEQ ID NO: 2705 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctaagcactggtatcatatct

SEQ ID NO: 2706 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagcactggtatcatatctgt

SEQ ID NO: 2707 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcactggtatcatatctgat

SEQ ID NO: 2708 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcactggtatcatatctgatt

SEQ ID NO: 2709 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cactggtatcatatctgattt

SEQ ID NO: 2710 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtatcatatctgattcact

SEQ ID NO: 2711 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcagagtttctgggttactgt

SEQ ID NO: 2712 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaatttgcctctaaaccttt

SEQ ID NO: 2713 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgaagtcctgctataccact

SEQ ID NO: 2714 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgctataccacagagttctt

SEQ ID NO: 2715 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgctataccacagagttctat

SEQ ID NO: 2716 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctataccacagagttctatt

SEQ ID NO: 2717 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctataccacagagttctatgt

SEQ ID NO: 2718 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ataccacagagttctatgtat

SEQ ID NO: 2719 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accacagagttctatgtagct

SEQ ID NO: 2720 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccacagagttctatgtagctt

SEQ ID NO: 2721 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagttctatgtagcttacat

SEQ ID NO: 2722 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagttctatgtagcttacagt

SEQ ID NO: 2723 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctatgtagcttacagttcct

SEQ ID NO: 2724 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctatgtagcttacagttccat

SEQ ID NO: 2725 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgtagcttacagttccaat

SEQ ID NO: 2726 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagcttacagttccaaccagt

SEQ ID NO: 2727 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaatgtgatgtattttaatgt

SEQ ID NO: 2728 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acctattgtggctagatatat

SEQ ID NO: 2729 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctattgtggctagatatatt

SEQ ID NO: 2730 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tattgtggctagatatattat

SEQ ID NO: 2731 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgtggctagatatattagt

SEQ ID NO: 2732 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgtggctagatatattaggt

SEQ ID NO: 2733 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtggctagatatattaggat

SEQ ID NO: 2734 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggctagatatattaggatt

SEQ ID NO: 2735 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggctagatatattaggatctt

SEQ ID NO: 2736 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctagatatattaggatctct

SEQ ID NO: 2737 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctctgaaatgtatgtaaagt

SEQ ID NO: 2738 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtgttaaatgttaacagtt

SEQ ID NO: 2739 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acagttttccactatttctct

SEQ ID NO: 2740 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcaaacgccatttcttata

SEQ ID NO: 2741 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcaatcgccatttcttata

SEQ ID NO: 2742 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcatacgccatttcttata

SEQ ID NO: 2743 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgctaacgccatttcttata

SEQ ID NO: 2744 - RNA, 19 nt, synthetic construct
  source 1..19: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaacgccatttcttata

SEQ ID NO: 2745 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcaaacgccatttcttatt

SEQ ID NO: 2746 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..11: note = RNA
  misc_feature 13..21: note = RNA
  misc_feature 12: note = DNA
atgcaaacgccatttcttatt

SEQ ID NO: 2747 - RNA, 19 nt, synthetic construct
  source 1..19: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaacgccatttcttatt

SEQ ID NO: 2748 - DNA, 19 bp, synthetic construct
  source 1..19: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..9: note = RNA
  misc_feature 11..19: note = RNA
  misc_feature 10: note = DNA
gcaaacgccatttcttatt

SEQ ID NO: 2749 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcaatcgccatttcttatt

SEQ ID NO: 2750 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..11: note = RNA
  misc_feature 13..21: note = RNA
  misc_feature 12: note = DNA
atgcaatcgccatttcttatt

SEQ ID NO: 2751 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcatacgccatttcttatt

SEQ ID NO: 2752 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..11: note = RNA
  misc_feature 13..21: note = RNA
  misc_feature 12: note = DNA
atgcatacgccatttcttatt

SEQ ID NO: 2753 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgctaacgccatttcttatt

SEQ ID NO: 2754 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..11: note = RNA
  misc_feature 13..21: note = RNA
  misc_feature 12: note = DNA
atgctaacgccatttcttatt

SEQ ID NO: 2755 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcaaacgccatttcttata

SEQ ID NO: 2756 - RNA, 19 nt, synthetic construct
  source 1..19: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaacgccatttcttata

SEQ ID NO: 2757 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-deoxy-2'-fluoroadenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcatacgccatttcttata

SEQ ID NO: 2758 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcctcacacacatttattt

SEQ ID NO: 2759 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctcacacacatctattattct

SEQ ID NO: 2760 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctcacacacatctatttctct

SEQ ID NO: 2761 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgtacacagtcattggatt

SEQ ID NO: 2762 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaggcttacattgacattat

SEQ ID NO: 2763 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaggcttacattgatattat

SEQ ID NO: 2764 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaggcttacattgtcattat

SEQ ID NO: 2765 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggcttacattgacattaat

SEQ ID NO: 2766 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggcttacattgactttaat

SEQ ID NO: 2767 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggcttacattgatattaat

SEQ ID NO: 2768 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacattgacattaaatactgt

SEQ ID NO: 2769 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacattgacattaataactgt

SEQ ID NO: 2770 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacctgtaataccagtgaatt

SEQ ID NO: 2771 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacctgtaataccatcgaatt

SEQ ID NO: 2772 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcggaattcttggtcctattt

SEQ ID NO: 2773 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcggaattcttggtcttattt

SEQ ID NO: 2774 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcggaattcttggttctattt

SEQ ID NO: 2775 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagaagagctggtattatgt

SEQ ID NO: 2776 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagaagagctggttctatgt

SEQ ID NO: 2777 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taagcactggtatcttatctt

SEQ ID NO: 2778 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgctataccacagatttctt

SEQ ID NO: 2779 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgctataccacagtgttctt

SEQ ID NO: 2780 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagttctatgtagtttacat

SEQ ID NO: 2781 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctatgtagcttacatttcct

SEQ ID NO: 2782 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctatgtagcttactgttcct

SEQ ID NO: 2783 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctattgtggctagatttattt

SEQ ID NO: 2784 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccatggtggacaagtttttt

SEQ ID NO: 2785 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccatggtggacaatattttt

SEQ ID NO: 2786 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagatttttgaaggaaatact

SEQ ID NO: 2787 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagatttttgaaggatatact

SEQ ID NO: 2788 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagatttttgaaggtaatact

SEQ ID NO: 2789 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agatttttgaaggaattactt

SEQ ID NO: 2790 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agatttttgaaggatatactt

SEQ ID NO: 2791 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggcttacattgacattaaa

SEQ ID NO: 2792 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
actagaattcatggaagttaaca

SEQ ID NO: 2793 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aagaattgagaactgagttcttg

SEQ ID NO: 2794 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aaagtatcattgagagtaggaga

SEQ ID NO: 2795 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
agaacacgattttgagtgtgtct

SEQ ID NO: 2796 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
atagaattcatggaagttaacat

SEQ ID NO: 2797 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aaaaagtatcattgagagtagga

SEQ ID NO: 2798 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
aagaaatagtggaaaactgttaa

SEQ ID NO: 2799 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
acaagatcatgaaagacatatag

SEQ ID NO: 2800 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
actaaagtgaaccttgatggtgt

SEQ ID NO: 2801 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atttctaaagtgaaccttgatgg

SEQ ID NO: 2802 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
acgttgaagtgaatagaaaacaa

SEQ ID NO: 2803 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
acttgtagaactgatgtgacagc

SEQ ID NO: 2804 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
acattgatagtgttcatgatgtt

SEQ ID NO: 2805 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
atgataaatctcatatgagtctt

SEQ ID NO: 2806 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
aagaatcatgaattttccgagtt

SEQ ID NO: 2807 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
aagttgaaatcctcgattagatt

SEQ ID NO: 2808 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aaaggtttcttgaggattttgag

SEQ ID NO: 2809 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
attactaaggtttcttgaggatt

SEQ ID NO: 2810 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aatgatattctgttgaagggttg

SEQ ID NO: 2811 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
aaatgatattctgttgaagggtt

SEQ ID NO: 2812 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aaagaagtattctttggatttga

SEQ ID NO: 2813 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
atgaatgattgagtagtcttttc

SEQ ID NO: 2814 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
aaatgaatgattgagtagtcttt

SEQ ID NO: 2815 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
ataatgaatgattgagtagtctt

SEQ ID NO: 2816 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
aaggaaatgttggagagtgttcc

SEQ ID NO: 2817 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
aaaagtagagttgacttcatctt

SEQ ID NO: 2818 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
aaggtgaaagtagagttgacttc

SEQ ID NO: 2819 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aaaagatgtttgactaatgtcat

SEQ ID NO: 2820 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aagatttaagtctgaggaaggga

SEQ ID NO: 2821 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
agtaaagagatttaagtctgagg

SEQ ID NO: 2822 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aataattgtttgatccaattctg

SEQ ID NO: 2823 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agagtttctgaatgacctaattc

SEQ ID NO: 2824 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
agtaagattgtactcttcttctt

SEQ ID NO: 2825 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acaattatatctgtgttcgaaga

SEQ ID NO: 2826 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agaagatgcagtaatttgcttgt

SEQ ID NO: 2827 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
agatttatgaagcaacaatgaat

SEQ ID NO: 2828 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
acattcgaggaattctgattatg

SEQ ID NO: 2829 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aaataactgactagattcagaag

SEQ ID NO: 2830 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aggtttttgaatattcagttcta

SEQ ID NO: 2831 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aattcaaacttgagtttgtgggc

SEQ ID NO: 2832 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaaggaagttacagaaagattc

SEQ ID NO: 2833 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acttaaaatatggttcatactct

SEQ ID NO: 2834 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaagaagtcctgaaatggtagat

SEQ ID NO: 2835 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatagatgtgtgtgaggcatgga

SEQ ID NO: 2836 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggagtaatagatgtgtgtgagg

SEQ ID NO: 2837 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atttcatgggagtaatagatgtg

SEQ ID NO: 2838 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagttgaaatcctcgatcagatt

SEQ ID NO: 2839 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atcaaacgtcttctgtgtcccac

SEQ ID NO: 2840 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtcaaacgtcttctgtgtccca

SEQ ID NO: 2841 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atgtcaaacgtcttctgtgtccc

SEQ ID NO: 2842 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atttgcttgtcaaacgtcttctg

SEQ ID NO: 2843 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aacgatttgcttgtcaaacgtct

(The sequence listing continues in the following parts.)

We claim:

1. A double stranded ribonucleic acid (dsRNA) agent for inhibiting expression of coagulation Factor V (F5) in a cell, or a pharmaceutically acceptable salt thereof, comprising a sense strand differing by no more than 4 unmodified or modified bases from the nucleotide sequence 5'-ascsaguuuuCfCfAfcuauuucucu-3' of SEQ ID NO:2739 and an antisense strand differing by no more than 4 unmodified or modified bases from the nucleotide sequence 5'-asdGsagdAadAuagudGgAfaaacugususa-3' of SEQ ID NO:2940, wherein a, g, c and u are 2'-O-methyl (2'-OMe) A, G, C, and U, respectively; Af and Cf, are 2'-fluoro A and C, respectively; s is a phosphorothioate linkage; dG is 2-deoxyguanosine-3'-phosphate; and dA is 2-deoxyadenosine-3-phosphate.

2. The dsRNA agent, or a pharmaceutically acceptable salt thereof, of claim 1, comprising a sense strand differing by no more than 3 unmodified or modified bases from the nucleotide sequence 5'-ascsaguuuuCfCfAfcuauuucucu-3' of SEQ ID NO:2739 and an antisense strand differing by no more than 3 unmodified or modified bases from the nucleotide sequence 5'-asdGsagdAadAuagudGgAfaaacugususa-3' of SEQ ID NO:2940.

3. The dsRNA agent, or a pharmaceutically acceptable salt thereof, of claim 1, comprising a sense strand differing by no more than 2 unmodified or modified bases from the nucleotide sequence 5'-ascsaguuuuCfCfAfcuauuucucu-3' of SEQ ID NO:2739 and an antisense strand differing by no more than 2 unmodified or modified bases from the nucleotide sequence 5'-asdGsagdAadAuagudGgAfaaacugususa-3' of SEQ ID NO:2940.

4. The dsRNA agent, or a pharmaceutically acceptable salt thereof, of claim 1, comprising a sense strand differing by no more than 1 unmodified or modified base from the nucleotide sequence 5'-ascsaguuuuCfCfAfcuauuucucu-3' of SEQ ID NO:2739 and an antisense strand differing by no more than 1 unmodified or modified base from the nucleotide sequence 5'-asdGsagdAadAuagudGgAfaaacugususa-3' of SEQ ID NO:2940.

5. The dsRNA agent, or a pharmaceutically acceptable salt thereof, of claim 1, comprising a sense strand comprising the nucleotide sequence 5'-ascsaguuuuCfCfAfcuauuucucu-3' of SEQ ID NO:2739 and an antisense strand comprising the nucleotide sequence 5'-asdGsagdAadAuagudGgAfaaacugususa-3' of SEQ ID NO:2940.

6. The dsRNA agent, or a pharmaceutically acceptable salt thereof, of claim 1, comprising a sense strand consisting of the nucleotide sequence 5'-ascsaguuuuCfCfAfcuauuucucu-3' of SEQ ID NO:2739 and an antisense strand consisting of the nucleotide sequence 5'-asdGsagdAadAuagudGgAfaaacugususa-3' of SEQ ID NO:2940.

7. The dsRNA agent, or a pharmaceutically acceptable salt thereof, of claim 1, further comprising a ligand.

8. The dsRNA agent, or a pharmaceutically acceptable salt thereof, of claim 7, wherein the ligand is conjugated to the 3' end of the sense strand of the dsRNA agent.

9. The dsRNA agent, or a pharmaceutically acceptable salt thereof, of claim 7, wherein the ligand is an N-acetylgalactosamine (GalNAc) derivative.

10. The dsRNA agent, or a pharmaceutically acceptable salt thereof, of claim 9, wherein the ligand is one or more GalNAc derivatives attached through a monovalent, bivalent, or trivalent linker.

11. The dsRNA agent, or a pharmaceutically acceptable salt thereof, of claim 10, wherein the ligand is

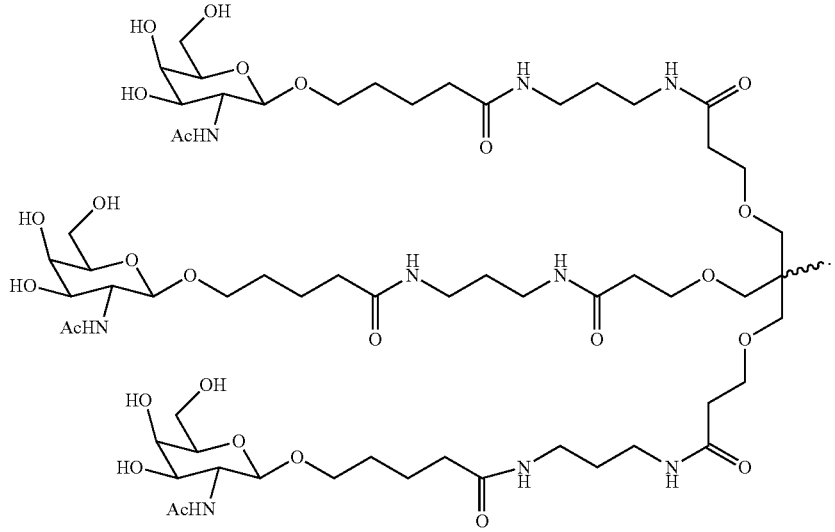 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

12. The dsRNA agent, or a pharmaceutically acceptable salt thereof, of claim 11, wherein the dsRNA agent, or a pharmaceutically acceptable salt thereof, is conjugated to the ligand as shown in the following schematic

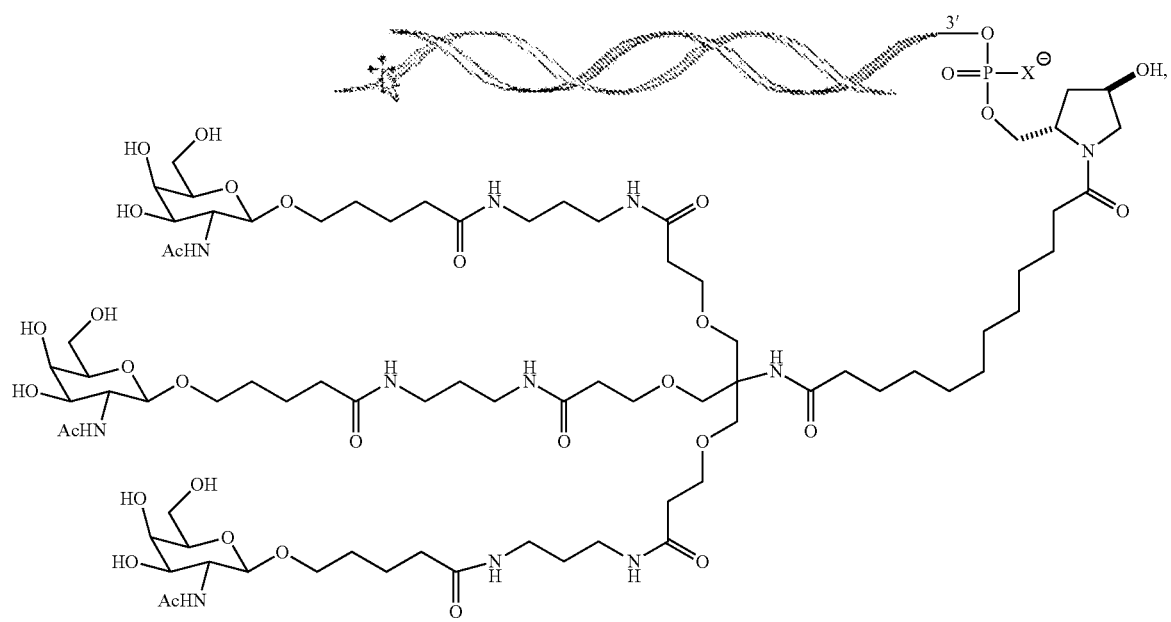

wherein X is O or S.

13. The dsRNA agent, or a pharmaceutically acceptable salt thereof, of claim 12, wherein X is O.

14. An isolated cell containing the dsRNA agent, or a pharmaceutically acceptable salt thereof, of claim 1.

15. A pharmaceutical composition, comprising the dsRNA agent, or a pharmaceutically acceptable salt thereof, of claim 1.

16. The pharmaceutical composition of claim 15, wherein the dsRNA agent, or a pharmaceutically acceptable salt thereof, is in an unbuffered solution.

17. The pharmaceutical composition of claim 16, wherein the unbuffered solution is saline or water.

18. The pharmaceutical composition of claim 15, wherein the dsRNA agent, or a pharmaceutically acceptable salt thereof, is in a buffer solution.

19. The pharmaceutical composition of claim 18, wherein the buffer solution comprises acetate, citrate, prolamine, carbonate, or phosphate or any combination thereof.

20. The pharmaceutical composition of claim 19, wherein the buffer solution is phosphate buffered saline (PBS).

21. A double stranded ribonucleic acid (dsRNA) agent for inhibiting expression of coagulation Factor V (F5) in a cell, or a pharmaceutically acceptable salt thereof, comprising a sense strand comprising the nucleotide sequence 5'-ascsaguuuuCfCfAfcuauuucucu-3' of SEQ ID NO:2739 and an antisense strand comprising the nucleotide sequence 5'-asdGsagdAadAuagudGgAfaaacugususa-3' of SEQ ID NO:2940, wherein a, g, c and u are 2'-O-methyl (2'-OMe) A, G, C, and U, respectively; Af and Cf, are 2'-fluoro A and C, respectively; s is a phosphorothioate linkage; dG is 2-deoxyguanosine-3-phosphate; and dA is 2-deoxyadenosine-3-phosphate, wherein the 3'-end of the sense strand of the dsRNA agent is conjugated to a ligand as shown in the following schematic

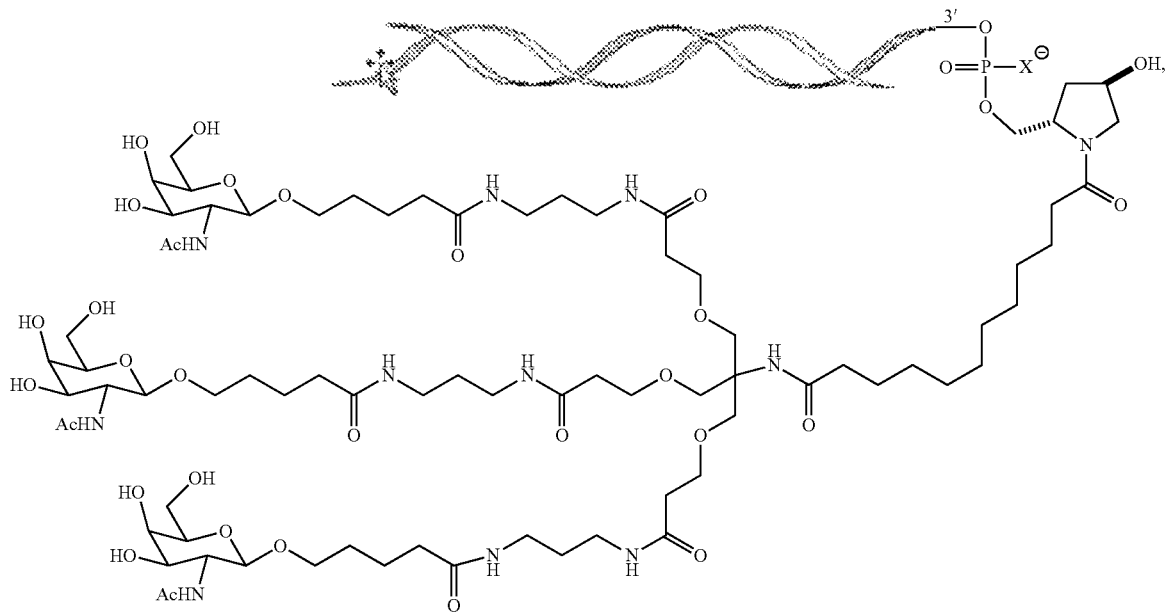

and wherein X is O.

22. The dsRNA agent, or a pharmaceutically acceptable salt thereof, of claim 21, which is in a sodium salt form.

23. An isolated cell containing the dsRNA agent, or a pharmaceutically acceptable salt thereof, of claim 21.

24. A pharmaceutical composition comprising the dsRNA agent, or a pharmaceutically acceptable salt thereof, of claim 21.

25. A double stranded ribonucleic acid (dsRNA) agent for inhibiting expression of coagulation Factor V (F5) in a cell, or a pharmaceutically acceptable salt thereof, consisting of a sense strand consisting of the nucleotide sequence 5'-ascsaguuuuCfCfAfcuauuucucu-3' of SEQ ID NO:2739 and an antisense strand consisting of the nucleotide sequence 5'-asdGsagdAadAuagudGgAfaaacugususa-3' of SEQ ID NO:2940, wherein a, g, c and u are 2'-O-methyl (2'-OMe) A, G, C, and U, respectively; Af and Cf, are 2'-fluoro A and C, respectively; s is a phosphorothioate linkage; dG is 2-deoxyguanosine-3-phosphate; and dA is 2-deoxyadenosine-3-phosphate, wherein the 3'-end of the sense strand of the dsRNA agent is conjugated to a ligand as shown in the following schematic

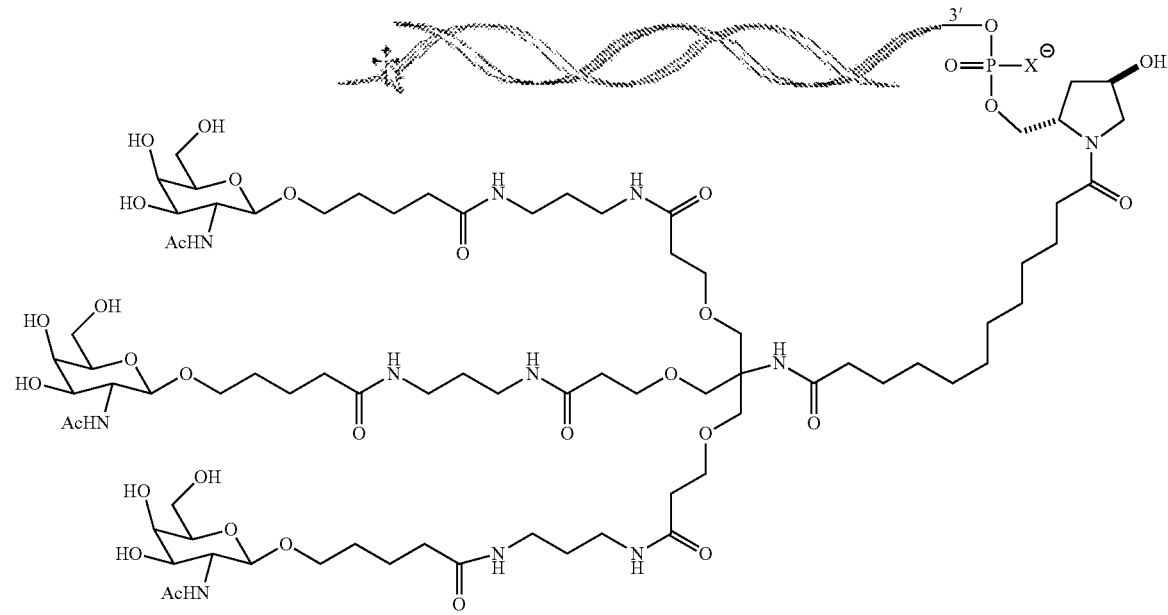

and wherein X is O.

26. The dsRNA agent, or a pharmaceutically acceptable salt thereof, of claim 25, which is in a sodium salt form.

27. An isolated cell containing the dsRNA agent, or a pharmaceutically acceptable salt thereof, of claim 25.

28. A pharmaceutical composition comprising the dsRNA agent, or a pharmaceutically acceptable salt thereof, of claim 25.

* * * * *